United States Patent 7,250,496 (BIOINFORMATICALLY DETECTABLE GROUP OF NOVEL REGULATORY GENES AND USES THEREOF) - sequence listing, part 32

SEQ ID NO: 1374005 - RNA, 25 nt, Human
aaagaaaaucacaguuuaaacagaa

SEQ ID NO: 1374006 - RNA, 26 nt, Human
aacaaaaacaaaguuuugcccacaga

SEQ ID NO: 1374007 - RNA, 19 nt, Human
aacuauauaacucagaagu

SEQ ID NO: 1374008 - RNA, 21 nt, Human
aacuauauaacucagaaguca

SEQ ID NO: 1374009 - RNA, 24 nt, Human
aauaaggcaagucacaccuuuuag

SEQ ID NO: 1374010 - RNA, 27 nt, Human
agaaagcuuucauaguuaacuuaccaa

SEQ ID NO: 1374011 - RNA, 25 nt, Human
agaaggaaaagaaccaacauucuaa

SEQ ID NO: 1374012 - RNA, 23 nt, Human
agaugcaaccuuuucucucccuu

SEQ ID NO: 1374013 - RNA, 19 nt, Human
aggacaugaagaaaaccaa

SEQ ID NO: 1374014 - RNA, 19 nt, Human
aggcagaaggaaaagaacc

SEQ ID NO: 1374015 - RNA, 23 nt, Human
aggcauccugcagaugcaaccuu

SEQ ID NO: 1374016 - RNA, 22 nt, Human
aggggggcuggggacgguaaaa

SEQ ID NO: 1374017 - RNA, 20 nt, Human
aguacagcccucaacaaaac

SEQ ID NO: 1374018 - RNA, 21 nt, Human
agugaaucuuuccugucucuu

SEQ ID NO: 1374019 - RNA, 19 nt, Human
aucacaggaaucccuggcu

SEQ ID NO: 1374020 - RNA, 20 nt, Human
augaagcacccaaagacuca

SEQ ID NO: 1374021 - RNA, 21 nt, Human
auggcacuccuaccuucuuuu

SEQ ID NO: 1374022 - RNA, 24 nt, Human
auuuaaaaacauaucugauaaccc

SEQ ID NO: 1374023 - RNA, 22 nt, Human
caaaaugaaaauuccaaggcca

SEQ ID NO: 1374024 - RNA, 23 nt, Human
caaccuuuucucucccuucuuuc

SEQ ID NO: 1374025 - RNA, 25 nt, Human
caagucuucaccccuucaguucaua

SEQ ID NO: 1374026 - RNA, 19 nt, Human
cacacacacgaaagcaaaa

SEQ ID NO: 1374027 - RNA, 19 nt, Human
caccaacacaauaaagaaa

SEQ ID NO: 1374028 - RNA, 25 nt, Human
cacuucaauuucacagggacacuuc

SEQ ID NO: 1374029 - RNA, 22 nt, Human
cagaaggaaaagaaccaacauu

SEQ ID NO: 1374030 - RNA, 18 nt, Human
caggcgcucgcggcaggg

SEQ ID NO: 1374031 - RNA, 21 nt, Human
cagggauauauauacgaccau

SEQ ID NO: 1374032 - RNA, 24 nt, Human
caguauucugcaggggaagcacca

SEQ ID NO: 1374033 - RNA, 18 nt, Human
ccaaaaaggcagaaggaa

SEQ ID NO: 1374034 - RNA, 19 nt, Human
ccaagcaaauaacagcagc

SEQ ID NO: 1374035 - RNA, 24 nt, Human
ccaguaucauuucaauaaggcaag

SEQ ID NO: 1374036 - RNA, 21 nt, Human
cccggagccggggucgcgagc

SEQ ID NO: 1374037 - RNA, 21 nt, Human
ccgccgggcgacucuuuccug

SEQ ID NO: 1374038 - RNA, 23 nt, Human
ccuuguuuuguugcccucuccaa

SEQ ID NO: 1374039 - RNA, 20 nt, Human
ccuuuucucucccuucuuuc

SEQ ID NO: 1374040 - RNA, 24 nt, Human
cgaaagcaaaauuuaaaaaccaaa

SEQ ID NO: 1374041 - RNA, 21 nt, Human
cgccgggcgacucuuuccugc

SEQ ID NO: 1374042 - RNA, 20 nt, Human
cuauuuuuggugaacaugcu

SEQ ID NO: 1374043 - RNA, 20 nt, Human
cucacaaaaccaacagaugg

SEQ ID NO: 1374044 - RNA, 21 nt, Human
cucacaaaaccaacagaugga

SEQ ID NO: 1374045 - RNA, 24 nt, Human
cucagaagucaauaaacaguugaa

SEQ ID NO: 1374046 - RNA, 21 nt, Human
cucucagcucacaaaaccaac

SEQ ID NO: 1374047 - RNA, 19 nt, Human
cucucccuucuuucucuuu

SEQ ID NO: 1374048 - RNA, 21 nt, Human
cuguggguuaaauuguuacau

SEQ ID NO: 1374049 - RNA, 18 nt, Human
cuuccauguguccagaga

SEQ ID NO: 1374050 - RNA, 20 nt, Human
cuugugcggcaauccugccg

SEQ ID NO: 1374051 - RNA, 22 nt, Human
cuuuucucucccuucuuucucu

SEQ ID NO: 1374052 - RNA, 21 nt, Human
gacucuuuccugccccugagg

SEQ ID NO: 1374053 - RNA, 20 nt, Human
gacuguguaguuaucaaggc

SEQ ID NO: 1374054 - RNA, 25 nt, Human
gcaaaacaaaaacaaaguuuugccc

SEQ ID NO: 1374055 - RNA, 24 nt, Human
gcagaggagagagguaagcccaga

SEQ ID NO: 1374056 - RNA, 18 nt, Human
gcagaggcccggagccgg

SEQ ID NO: 1374057 - RNA, 22 nt, Human
ggauauauauacgaccaucaua

SEQ ID NO: 1374058 - RNA, 20 nt, Human
ggucggcagaggcccggagc

SEQ ID NO: 1374059 - RNA, 24 nt, Human
guaaaacacugcucagacuuucag

SEQ ID NO: 1374060 - RNA, 24 nt, Human
guagaauucuccacauucauaaaa

SEQ ID NO: 1374061 - RNA, 20 nt, Human
gugaaucuuuccugucucuu

SEQ ID NO: 1374062 - RNA, 18 nt, Human
uaaaaacauaucugauaa

SEQ ID NO: 1374063 - RNA, 20 nt, Human
uaaaaaguacagcccucaac

SEQ ID NO: 1374064 - RNA, 25 nt, Human
uaaaacgaacccauaggguucaaac

SEQ ID NO: 1374065 - RNA, 22 nt, Human
uaaauagcggcuuacaaugaaa

SEQ ID NO: 1374066 - RNA, 25 nt, Human
uaaccaagcaaauaacagcagcuac

SEQ ID NO: 1374067 - RNA, 21 nt, Human
uaacucagaagucaauaaaca

SEQ ID NO: 1374068 - RNA, 22 nt, Human
uaacucagaagucaauaaacag

SEQ ID NO: 1374069 - RNA, 20 nt, Human
uaacuuaccaaaaacauaac

SEQ ID NO: 1374070 - RNA, 26 nt, Human
uaacuuaccaaaaacauaacgcuugc

SEQ ID NO: 1374071 - RNA, 20 nt, Human
uaacuuacugaauuuucccc

SEQ ID NO: 1374072 - RNA, 20 nt, Human
uaacuuacugaauuuucccc

SEQ ID NO: 1374073 - RNA, 24 nt, Human
uacaaaguaauuuuuuuuccugug

SEQ ID NO: 1374074 - RNA, 24 nt, Human
uacugugcaaaacaaaaacaaagu

SEQ ID NO: 1374075 - RNA, 23 nt, Human
uaggaaaucaugaagcacccaaa

SEQ ID NO: 1374076 - RNA, 21 nt, Human
uaggaccucauaugaccauga

SEQ ID NO: 1374077 - RNA, 24 nt, Human
uagugaaggauuccuuuaaguugu

SEQ ID NO: 1374078 - RNA, 26 nt, Human
uaguuaacuuaccaaaaacauaacgc

SEQ ID NO: 1374079 - RNA, 21 nt, Human
ucaggacuuccauuacauucu

SEQ ID NO: 1374080 - RNA, 18 nt, Human
ucaugaagcacccaaaga

SEQ ID NO: 1374081 - RNA, 22 nt, Human
uccuguuggucugaauauccug

SEQ ID NO: 1374082 - RNA, 20 nt, Human
ucucacauucuuuaauuucu

SEQ ID NO: 1374083 - RNA, 21 nt, Human
ugaaaagcauacauuugccua

SEQ ID NO: 1374084 - RNA, 18 nt, Human
ugaaaauuccaaggccac

SEQ ID NO: 1374085 - RNA, 20 nt, Human
ugaaagaacuaugcacgaug

SEQ ID NO: 1374086 - RNA, 24 nt, Human
ugaagaaaaccaaaguacucugcu

SEQ ID NO: 1374087 - RNA, 22 nt, Human
ugaagcacccaaagacucagga

SEQ ID NO: 1374088 - RNA, 18 nt, Human
ugacaauuucaguagcac

SEQ ID NO: 1374089 - RNA, 19 nt, Human
ugcucagacuuucagcagc

SEQ ID NO: 1374090 - RNA, 24 nt, Human
ugcucucagcucacaaaaccaaca

SEQ ID NO: 1374091 - RNA, 23 nt, Human
uggaaggaaaagcaagugaacau

SEQ ID NO: 1374092 - RNA, 18 nt, Human
uggcuguaaacagcagca

SEQ ID NO: 1374093 - RNA, 24 nt, Human
ugggaggggggcuggggacgguaa

SEQ ID NO: 1374094 - RNA, 24 nt, Human
uggucuaacaguuuugcauugugg

SEQ ID NO: 1374095 - RNA, 22 nt, Human
uguaucacaggaaucccuggcu

SEQ ID NO: 1374096 - RNA, 18 nt, Human
ugugcaaaacaaaaacaa

SEQ ID NO: 1374097 - RNA, 24 nt, Human
ugugggaauuuaaauagcggcuua

SEQ ID NO: 1374098 - RNA, 24 nt, Human
uguguagaaaauucccugaucaaa

SEQ ID NO: 1374099 - RNA, 19 nt, Human
uguuucuuucauuauguuu

SEQ ID NO: 1374100 - RNA, 24 nt, Human
uuaaaaacauaucugauaacccca

SEQ ID NO: 1374101 - RNA, 23 nt, Human
uuaaagacacacacacgaaagca

SEQ ID NO: 1374102 - RNA, 21 nt, Human
uucaaacaagcauacaaagua

SEQ ID NO: 1374103 - RNA, 19 nt, Human
uucaagugaaucuuuccug

SEQ ID NO: 1374104 - RNA, 21 nt, Human
uucaauguagaauucuccaca

SEQ ID NO: 1374105 - RNA, 23 nt, Human
uucaccccuucaguucauaucgc

SEQ ID NO: 1374106 - RNA, 23 nt, Human
uucauuaggaccucauaugacca

SEQ ID NO: 1374107 - RNA, 20 nt, Human
uucccaaaaaggcagaagga

SEQ ID NO: 1374108 - RNA, 20 nt, Human
uucucuuaaguccuacagag

SEQ ID NO: 1374109 - RNA, 18 nt, Human
uucuguuucaauguagaa

SEQ ID NO: 1374110 - RNA, 20 nt, Human
uugaaagaaaaaucaaucau

SEQ ID NO: 1374111 - RNA, 25 nt, Human
uugguguuuauuuugacauucucuu

SEQ ID NO: 1374112 - RNA, 21 nt, Human
uugugggaauuuaaauagcgg

SEQ ID NO: 1374113 - RNA, 28 nt, Human
uuuaaaaacauaucugauaaccccauua

SEQ ID NO: 1374114 - RNA, 20 nt, Human
uuucaagaaacccuuucuug

SEQ ID NO: 1374115 - RNA, 20 nt, Human
uuuccugucucuuucccaaa

SEQ ID NO: 1374116 - RNA, 21 nt, Human
uuugcacaucuucaucccagu

SEQ ID NO: 1374117 - RNA, 18 nt, Human
aaaaacugaggaaaacuc

SEQ ID NO: 1374118 - RNA, 20 nt, Human
aaaacacagacauaggcagc

SEQ ID NO: 1374119 - RNA, 20 nt, Human
aaagacauagcaugugcaaa

SEQ ID NO: 1374120 - RNA, 28 nt, Human
aaaguacugggauuaauuauaggcauga

SEQ ID NO: 1374121 - RNA, 19 nt, Human
aacagccaucaggaucauc

SEQ ID NO: 1374122 - RNA, 23 nt, Human
aacccaccgagaggaaggaacaa

SEQ ID NO: 1374123 - RNA, 22 nt, Human
aagaaacuccgaacacaucuga

SEQ ID NO: 1374124 - RNA, 24 nt, Human
aagugauccacccaccuuggccuc

SEQ ID NO: 1374125 - RNA, 21 nt, Human
aauuauaggcaugagccacug

SEQ ID NO: 1374126 - RNA, 21 nt, Human
aauuauaggcaugagccacug

SEQ ID NO: 1374127 - RNA, 24 nt, Human
aauuauaggcaugagccacugugc

SEQ ID NO: 1374128 - RNA, 19 nt, Human
acaaaucucauucuacaac

SEQ ID NO: 1374129 - RNA, 21 nt, Human
acaucagaaggagcaaacucc

SEQ ID NO: 1374130 - RNA, 24 nt, Human
acuccuggcuucaagugauccacc

SEQ ID NO: 1374131 - RNA, 23 nt, Human
acugcgaaggucugcagcuucac

SEQ ID NO: 1374132 - RNA, 19 nt, Human
agaaggaagaaacuccgaa

SEQ ID NO: 1374133 - RNA, 18 nt, Human
agcaggaugugggugggg

SEQ ID NO: 1374134 - RNA, 23 nt, Human
agccggcaguggcaacccgcucg

SEQ ID NO: 1374135 - RNA, 21 nt, Human
aggaagaaaaacugaggaaaa

SEQ ID NO: 1374136 - RNA, 22 nt, Human
aggcaugagccacugugcccca

SEQ ID NO: 1374137 - RNA, 19 nt, Human
agguagagguguccucagg

SEQ ID NO: 1374138 - RNA, 24 nt, Human
agguagucagcacucugucaaaac

SEQ ID NO: 1374139 - RNA, 19 nt, Human
agguguccucagggaauag

SEQ ID NO: 1374140 - RNA, 19 nt, Human
agugauccacccaccuugg

SEQ ID NO: 1374141 - RNA, 21 nt, Human
auaaaaacacagacauaggca

SEQ ID NO: 1374142 - RNA, 24 nt, Human
auggaauuucgccauguuggccag

SEQ ID NO: 1374143 - RNA, 22 nt, Human
caaaagacauagcaugugcaaa

SEQ ID NO: 1374144 - RNA, 28 nt, Human
caaaguacugggauuaauuauaggcaug

SEQ ID NO: 1374145 - RNA, 20 nt, Human
caagauaugcuguaauuuac

SEQ ID NO: 1374146 - RNA, 24 nt, Human
cacagacauaggcagccuuguaua

SEQ ID NO: 1374147 - RNA, 19 nt, Human
caccagaaggaagaaacuc

SEQ ID NO: 1374148 - RNA, 22 nt, Human
caccagaaggaagaaacuccga

SEQ ID NO: 1374149 - RNA, 22 nt, Human
cacccaccuuggccucccaaag

SEQ ID NO: 1374150 - RNA, 23 nt, Human
cacccaccuuggccucccaaagu

SEQ ID NO: 1374151 - RNA, 23 nt, Human
cacucugucaaaacggaccaauc

SEQ ID NO: 1374152 - RNA, 24 nt, Human
cacucugucaaaacggaccaauca

SEQ ID NO: 1374153 - RNA, 24 nt, Human
cacugggccuguugcuguaucauc

SEQ ID NO: 1374154 - RNA, 22 nt, Human
cagaaggagcaaacuccggaca

SEQ ID NO: 1374155 - RNA, 21 nt, Human
cagagaacagggugguuucga

SEQ ID NO: 1374156 - RNA, 23 nt, Human
cagcacucugucaaaacggacca

SEQ ID NO: 1374157 - RNA, 20 nt, Human
cagccaucaggaucauccca

SEQ ID NO: 1374158 - RNA, 21 nt, Human
cagugagaccaagaacccacc

SEQ ID NO: 1374159 - RNA, 19 nt, Human
caguucauucagagaggga

SEQ ID NO: 1374160 - RNA, 24 nt, Human
cauguuggccaggcuggucuugaa

SEQ ID NO: 1374161 - RNA, 26 nt, Human
ccaaaguacugggauuaauuauaggc

SEQ ID NO: 1374162 - RNA, 28 nt, Human
ccaaaguacugggauuaauuauaggcau

SEQ ID NO: 1374163 - RNA, 19 nt, Human
ccagaagaccuacaugaug

SEQ ID NO: 1374164 - RNA, 21 nt, Human
ccaggcaugcauaaugcugag

SEQ ID NO: 1374165 - RNA, 19 nt, Human
ccauguuggccaggcuggu

SEQ ID NO: 1374166 - RNA, 21 nt, Human
ccauguuggccaggcuggucu

SEQ ID NO: 1374167 - RNA, 21 nt, Human
ccauguuggccaggcuggucu

SEQ ID NO: 1374168 - RNA, 27 nt, Human
cccaccagaaggaagaaacuccgaaca

SEQ ID NO: 1374169 - RNA, 19 nt, Human
cccugacucaggaaagcuc

SEQ ID NO: 1374170 - RNA, 20 nt, Human
ccugaagccagcgagaccac

SEQ ID NO: 1374171 - RNA, 18 nt, Human
ccuggcuucaagugaucc

SEQ ID NO: 1374172 - RNA, 24 nt, Human
ccuggcuucaagugauccacccac

SEQ ID NO: 1374173 - RNA, 18 nt, Human
cgaacccaccagaaggaa

SEQ ID NO: 1374174 - RNA, 26 nt, Human
cgaacccaccgagaggaaggaacaac

SEQ ID NO: 1374175 - RNA, 19 nt, Human
cgagaccacgaacccaccg

SEQ ID NO: 1374176 - RNA, 24 nt, Human
cgccauguuggccaggcuggucuu

SEQ ID NO: 1374177 - RNA, 27 nt, Human
cgccauguuggccaggcuggucuugaa

SEQ ID NO: 1374178 - RNA, 20 nt, Human
cuaucauagcugagauugcu

SEQ ID NO: 1374179 - RNA, 24 nt, Human
cuccaaagccuuaggaagccugga

SEQ ID NO: 1374180 - RNA, 27 nt, Human
cuccuggcuucaagugauccacccacc

SEQ ID NO: 1374181 - RNA, 22 nt, Human
cucucuguaaaauggaccaauc

SEQ ID NO: 1374182 - RNA, 19 nt, Human
cucuuugcaauaaaucuug

SEQ ID NO: 1374183 - RNA, 20 nt, Human
cugaagccagcgagaccacg

SEQ ID NO: 1374184 - RNA, 25 nt, Human
cugaagccagcgagaccacgaaccc

SEQ ID NO: 1374185 - RNA, 18 nt, Human
cugagccagcgagaccac

SEQ ID NO: 1374186 - RNA, 24 nt, Human
cugagccagcgagaccacgaaccc

SEQ ID NO: 1374187 - RNA, 19 nt, Human
cuguaaaauggaccaauca

SEQ ID NO: 1374188 - RNA, 21 nt, Human
cuugcaaacaaauccucucca

SEQ ID NO: 1374189 - RNA, 24 nt, Human
cuugcaaacaaauccucuccacuu

SEQ ID NO: 1374190 - RNA, 23 nt, Human
cuugcugcugcucacucuuuggg

SEQ ID NO: 1374191 - RNA, 23 nt, Human
cuuuaugagcuguaacacucacc

SEQ ID NO: 1374192 - RNA, 18 nt, Human
cuuuguucuuuugcucuu

SEQ ID NO: 1374193 - RNA, 23 nt, Human
gaccacgaacccaccagaaggaa

SEQ ID NO: 1374194 - RNA, 20 nt, Human
gagaccacgaacccaccaga

SEQ ID NO: 1374195 - RNA, 26 nt, Human
gagccacugugccccacaaucauucg

SEQ ID NO: 1374196 - RNA, 20 nt, Human
gagcuguaacacucaccgca

SEQ ID NO: 1374197 - RNA, 21 nt, Human
gaggaagaaaaacugaggaaa

SEQ ID NO: 1374198 - RNA, 20 nt, Human
gcagaauuuuccacaucgca

SEQ ID NO: 1374199 - RNA, 19 nt, Human
gcaugagccacugugcccc

SEQ ID NO: 1374200 - RNA, 22 nt, Human
ggaauuucgccauguuggccag

SEQ ID NO: 1374201 - RNA, 19 nt, Human
ggcuggucuugaacuccug

SEQ ID NO: 1374202 - RNA, 19 nt, Human
gggaagggugggggagaaa

SEQ ID NO: 1374203 - RNA, 22 nt, Human
gucaaaacggaccaaucagcuc

SEQ ID NO: 1374204 - RNA, 21 nt, Human
gucaccuuccacacuguggaa

SEQ ID NO: 1374205 - RNA, 24 nt, Human
gugauccacccaccuuggccuccc

SEQ ID NO: 1374206 - RNA, 22 nt, Human
gugucgggccccucacugggcc

SEQ ID NO: 1374207 - RNA, 18 nt, Human
uaaaaacacagacauagg

SEQ ID NO: 1374208 - RNA, 19 nt, Human
uaaaaacacagacauaggc

SEQ ID NO: 1374209 - RNA, 23 nt, Human
uaaaaacacagacauaggcagcc

SEQ ID NO: 1374210 - RNA, 27 nt, Human
uaaaaacacagacauaggcuggagacc

SEQ ID NO: 1374211 - RNA, 20 nt, Human
uaaaacagaccaauuggcuc

SEQ ID NO: 1374212 - RNA, 19 nt, Human
uaaaauggaccaaucagca

SEQ ID NO: 1374213 - RNA, 24 nt, Human
uaaaauggaccaaucagcaggaug

SEQ ID NO: 1374214 - RNA, 24 nt, Human
uacuagagauggaauuucgccaug

SEQ ID NO: 1374215 - RNA, 22 nt, Human
uagagauggaauuucgccaugu

SEQ ID NO: 1374216 - RNA, 23 nt, Human
uagcaugugcaaaggcccugacu

SEQ ID NO: 1374217 - RNA, 19 nt, Human
ucaagugauccacccaccu

SEQ ID NO: 1374218 - RNA, 18 nt, Human
ucacaugcagugagagac

SEQ ID NO: 1374219 - RNA, 21 nt, Human
ucacugggccuguugcuguau

SEQ ID NO: 1374220 - RNA, 19 nt, Human
ucagggaauagcccagcag

SEQ ID NO: 1374221 - RNA, 23 nt, Human
ucauucgugaacaacaaaauuuu

SEQ ID NO: 1374222 - RNA, 18 nt, Human
ucccaaaguacugggauu

SEQ ID NO: 1374223 - RNA, 28 nt, Human
ucccaaaguacugggauuaauuauaggc

SEQ ID NO: 1374224 - RNA, 20 nt, Human
uccgaacacaucugaacauc

SEQ ID NO: 1374225 - RNA, 22 nt, Human
uccggacacaccgccuuuaaga

SEQ ID NO: 1374226 - RNA, 22 nt, Human
ucgccauguuggccaggcuggu

SEQ ID NO: 1374227 - RNA, 24 nt, Human
ucgccauguuggccaggcuggucu

SEQ ID NO: 1374228 - RNA, 25 nt, Human
ucgggccccucacugggccuguugc

SEQ ID NO: 1374229 - RNA, 21 nt, Human
ucuugaacuccuggcuucaag

SEQ ID NO: 1374230 - RNA, 20 nt, Human
ucuuugcacuaaugcucuuc

SEQ ID NO: 1374231 - RNA, 21 nt, Human
ugaagaggggguacuugacca

SEQ ID NO: 1374232 - RNA, 19 nt, Human
ugacucaggaaagcuccaa

SEQ ID NO: 1374233 - RNA, 18 nt, Human
ugacugcugacgugaugg

SEQ ID NO: 1374234 - RNA, 18 nt, Human
ugagaccaagaacccacc

SEQ ID NO: 1374235 - RNA, 19 nt, Human
ugagaccaagaacccacca

SEQ ID NO: 1374236 - RNA, 23 nt, Human
ugagcuguaacacucaccgcaaa

SEQ ID NO: 1374237 - RNA, 24 nt, Human
ugauccacccaccuuggccuccca

SEQ ID NO: 1374238 - RNA, 30 nt, Human
ugccucccucaccucuucggcgucuuccaa

SEQ ID NO: 1374239 - RNA, 24 nt, Human
uggaauuucgccauguuggccagg

SEQ ID NO: 1374240 - RNA, 24 nt, Human
uggccaggcuggucuugaacuccu

SEQ ID NO: 1374241 - RNA, 22 nt, Human
uggcuucaagugauccacccac

SEQ ID NO: 1374242 - RNA, 19 nt, Human
ugggaaggaaccaggcaug

SEQ ID NO: 1374243 - RNA, 26 nt, Human
ugggaaggaaccaggcaugcauaaug

SEQ ID NO: 1374244 - RNA, 28 nt, Human
ugggauuaauuauaggcaugagccacug

SEQ ID NO: 1374245 - RNA, 20 nt, Human
ugucuuugcacuaaugcucu

SEQ ID NO: 1374246 - RNA, 18 nt, Human
uuacuagagauggaauuu

SEQ ID NO: 1374247 - RNA, 24 nt, Human
uuacuagagauggaauuucgccau

SEQ ID NO: 1374248 - RNA, 20 nt, Human
uucaagugauccacccaccu

SEQ ID NO: 1374249 - RNA, 24 nt, Human
uucaagugauccacccaccuuggc

SEQ ID NO: 1374250 - RNA, 18 nt, Human
uucgagcaggguuuggca

SEQ ID NO: 1374251 - RNA, 25 nt, Human
uucuuuugcucuuugcaauaaaucu

SEQ ID NO: 1374252 - RNA, 25 nt, Human
uugaagucagugagaccaagaaccc

SEQ ID NO: 1374253 - RNA, 21 nt, Human
uugcugcugcucacucuuugg

SEQ ID NO: 1374254 - RNA, 24 nt, Human
uuucgccauguuggccaggcuggu

SEQ ID NO: 1374255 - RNA, 20 nt, Human
uuuucagcuuuaaguucauc

SEQ ID NO: 1374256 - RNA, 24 nt, Human
uuuuuacuagagauggaauuucgc

SEQ ID NO: 1374257 - RNA, 20 nt, Human
aaaaaaagagcaaacaccau

SEQ ID NO: 1374258 - RNA, 20 nt, Human
aaacucggggcaagccggug

SEQ ID NO: 1374259 - RNA, 20 nt, Human
aaagaccugcauccucuucc

SEQ ID NO: 1374260 - RNA, 20 nt, Human
aaagcucccucagccccauu

SEQ ID NO: 1374261 - RNA, 20 nt, Human
aaaggaaccagggcaaagcu

SEQ ID NO: 1374262 - RNA, 23 nt, Human
aacagagccaccacagaaaacag

SEQ ID NO: 1374263 - RNA, 24 nt, Human
aacagcuucugggugucccuggca

SEQ ID NO: 1374264 - RNA, 20 nt, Human
aaccaaaggcaguguacggg

SEQ ID NO: 1374265 - RNA, 21 nt, Human
aaccacgcaguccccaucuug

SEQ ID NO: 1374266 - RNA, 18 nt, Human
aaccccucagucacuuca

SEQ ID NO: 1374267 - RNA, 21 nt, Human
aaccugcauauccaccucccu

SEQ ID NO: 1374268 - RNA, 19 nt, Human
aacgcagcacuccacuacc

SEQ ID NO: 1374269 - RNA, 23 nt, Human
aacuacagauaucguaugagucc

SEQ ID NO: 1374270 - RNA, 18 nt, Human
aagaggccuggcccacag

SEQ ID NO: 1374271 - RNA, 20 nt, Human
aagcaauggccccauuuccc

SEQ ID NO: 1374272 - RNA, 23 nt, Human
aagccugcagcccccauuuccag

SEQ ID NO: 1374273 - RNA, 27 nt, Human
aaggaaacacaauuuccgagggaaugg

SEQ ID NO: 1374274 - RNA, 20 nt, Human
aauccaucucucucgcaggc

SEQ ID NO: 1374275 - RNA, 21 nt, Human
aauguucuucccaaccuaccc

SEQ ID NO: 1374276 - RNA, 18 nt, Human
acacagcuccccgccccu

SEQ ID NO: 1374277 - RNA, 24 nt, Human
acacaguucaggugaagaaagacc

SEQ ID NO: 1374278 - RNA, 19 nt, Human
acaguaccccaucuccccu

SEQ ID NO: 1374279 - RNA, 20 nt, Human
accauuauuaccacaacuuc

SEQ ID NO: 1374280 - RNA, 19 nt, Human
accccaucuccccugaaca

SEQ ID NO: 1374281 - RNA, 22 nt, Human
acgugcacacggcucccaugcg

SEQ ID NO: 1374282 - RNA, 20 nt, Human
acuggagcccaaggacugug

SEQ ID NO: 1374283 - RNA, 21 nt, Human
agaaaacagagccaccacaga

SEQ ID NO: 1374284 - RNA, 24 nt, Human
agacagaagcaguggucgccagga

SEQ ID NO: 1374285 - RNA, 22 nt, Human
agacagaugcagugaccuggaa

SEQ ID NO: 1374286 - RNA, 24 nt, Human
agacccaaagaagcaaacugacag

SEQ ID NO: 1374287 - RNA, 19 nt, Human
agacgccagugaggccaac

SEQ ID NO: 1374288 - RNA, 19 nt, Human
agaggaagaaaacagggga

SEQ ID NO: 1374289 - RNA, 21 nt, Human
agagggugacugucauccccu

SEQ ID NO: 1374290 - RNA, 20 nt, Human
agcacaugguggagagacag

SEQ ID NO: 1374291 - RNA, 25 nt, Human
agcaccacagaaaacagagccacca

SEQ ID NO: 1374292 - RNA, 18 nt, Human
agccaugcuggcuuccuu

SEQ ID NO: 1374293 - RNA, 19 nt, Human
agccgcuggguccuagccc

SEQ ID NO: 1374294 - RNA, 19 nt, Human
agccgcuggguccuagccc

SEQ ID NO: 1374295 - RNA, 20 nt, Human
aggacccccagcccacgccc

SEQ ID NO: 1374296 - RNA, 18 nt, Human
agggguuggguugcccaa

SEQ ID NO: 1374297 - RNA, 23 nt, Human
aggugggaugagugaguguggcu

SEQ ID NO: 1374298 - RNA, 21 nt, Human
agugagggagccaggacucag

SEQ ID NO: 1374299 - RNA, 21 nt, Human
augagaacaccgaggcuuaga

SEQ ID NO: 1374300 - RNA, 25 nt, Human
caaagauaagcacaaaaggugcauc

SEQ ID NO: 1374301 - RNA, 18 nt, Human
caaagcucccucagcccc

SEQ ID NO: 1374302 - RNA, 19 nt, Human
caaagcucccucagcccca

SEQ ID NO: 1374303 - RNA, 21 nt, Human
caaccugcauauccaccuccc

SEQ ID NO: 1374304 - RNA, 22 nt, Human
caagcucagggccaagcugucc

SEQ ID NO: 1374305 - RNA, 19 nt, Human
cacaaaugagaacaccgag

SEQ ID NO: 1374306 - RNA, 18 nt, Human
cacagaaaacagagccac

SEQ ID NO: 1374307 - RNA, 22 nt, Human
cacagaaaacagagccaccaca

SEQ ID NO: 1374308 - RNA, 22 nt, Human
cacauccccaccgaaaaagccc

SEQ ID NO: 1374309 - RNA, 23 nt, Human
caccacguuccaagccacacuga

SEQ ID NO: 1374310 - RNA, 18 nt, Human
caccccccucccaccccu

SEQ ID NO: 1374311 - RNA, 25 nt, Human
caccccccucccaccccugugcagg

SEQ ID NO: 1374312 - RNA, 19 nt, Human
cacccugcccucccugcuu

SEQ ID NO: 1374313 - RNA, 21 nt, Human
cacccugcccucccugcuugc

SEQ ID NO: 1374314 - RNA, 20 nt, Human
cacggaacucacgcucacuc

SEQ ID NO: 1374315 - RNA, 18 nt, Human
cacucucucucccuucuu

SEQ ID NO: 1374316 - RNA, 20 nt, Human
cagaaaacagagggugacug

SEQ ID NO: 1374317 - RNA, 19 nt, Human
cagaagcaccccccuccca

SEQ ID NO: 1374318 - RNA, 23 nt, Human
cagaagcaccccccucccacccc

SEQ ID NO: 1374319 - RNA, 23 nt, Human
cagcaccacagaaaacagagcca

SEQ ID NO: 1374320 - RNA, 22 nt, Human
cagcacuccacuacccaggaaa

SEQ ID NO: 1374321 - RNA, 25 nt, Human
cagcacugccaauacaagaagcugc

SEQ ID NO: 1374322 - RNA, 23 nt, Human
cagcccuccagcucgccucccuc

SEQ ID NO: 1374323 - RNA, 19 nt, Human
cagcgcugucugugcuucc

SEQ ID NO: 1374324 - RNA, 24 nt, Human
cagcgcugucugugcuucccaugc

SEQ ID NO: 1374325 - RNA, 25 nt, Human
cagcuuggagaacccacacucaaug

SEQ ID NO: 1374326 - RNA, 18 nt, Human
caggacucaggcccaagg

SEQ ID NO: 1374327 - RNA, 21 nt, Human
caggcccaaggcuccugagag

SEQ ID NO: 1374328 - RNA, 19 nt, Human
cagggaagagauagcauuu

SEQ ID NO: 1374329 - RNA, 18 nt, Human
cagggccaagcuguccgc

SEQ ID NO: 1374330 - RNA, 20 nt, Human
cauacaccacguuccaagcc

SEQ ID NO: 1374331 - RNA, 20 nt, Human
cauauccaccucccuacccu

SEQ ID NO: 1374332 - RNA, 21 nt, Human
cauggaaggaaagcaaaacca

SEQ ID NO: 1374333 - RNA, 25 nt, Human
ccaaaaauccagcgcugcccucaga

SEQ ID NO: 1374334 - RNA, 20 nt, Human
ccaacucuucacucacugcc

SEQ ID NO: 1374335 - RNA, 18 nt, Human
ccaagccaggcuucccau

SEQ ID NO: 1374336 - RNA, 18 nt, Human
ccaagccaggugggauga

SEQ ID NO: 1374337 - RNA, 18 nt, Human
ccaagcuguccgccaacc

SEQ ID NO: 1374338 - RNA, 21 nt, Human
ccacacugaggccucccucca

SEQ ID NO: 1374339 - RNA, 19 nt, Human
ccacaggaggggcaagugg

SEQ ID NO: 1374340 - RNA, 19 nt, Human
ccacuggggucuaccaugu

SEQ ID NO: 1374341 - RNA, 18 nt, Human
ccaggacucaggcccaag

SEQ ID NO: 1374342 - RNA, 23 nt, Human
cccaaacucuucugucccauccc

SEQ ID NO: 1374343 - RNA, 21 nt, Human
cccacaggcucacggaaaguu

SEQ ID NO: 1374344 - RNA, 23 nt, Human
cccacuccacugccagucgucac

SEQ ID NO: 1374345 - RNA, 22 nt, Human
cccagcugcagcagagcaggag

SEQ ID NO: 1374346 - RNA, 26 nt, Human
cccaucccugcccugcucaaaaucca

SEQ ID NO: 1374347 - RNA, 21 nt, Human
cccauggacaacgaaaagccc

SEQ ID NO: 1374348 - RNA, 22 nt, Human
ccccacuccacugccagucguc

SEQ ID NO: 1374349 - RNA, 23 nt, Human
ccccacuccacugccagucguca

SEQ ID NO: 1374350 - RNA, 18 nt, Human
ccccagcccacgcccagg

SEQ ID NO: 1374351 - RNA, 21 nt, Human
cccccagcccacgcccagggc

SEQ ID NO: 1374352 - RNA, 23 nt, Human
ccccgagcgcggcuccaggaccc

SEQ ID NO: 1374353 - RNA, 22 nt, Human
ccccgccccucuucugcccuuc

SEQ ID NO: 1374354 - RNA, 23 nt, Human
ccccgccgcccccaguccgcccg

SEQ ID NO: 1374355 - RNA, 23 nt, Human
ccccggggcaggacccccagccc

SEQ ID NO: 1374356 - RNA, 19 nt, Human
ccccucccaccccugugca

SEQ ID NO: 1374357 - RNA, 21 nt, Human
ccccucuucugcccuucaucc

SEQ ID NO: 1374358 - RNA, 23 nt, Human
ccccugucguauccugacuacaa

SEQ ID NO: 1374359 - RNA, 20 nt, Human
cccggggugcgccccggggc

SEQ ID NO: 1374360 - RNA, 18 nt, Human
cccuccgcugcgcccucc

SEQ ID NO: 1374361 - RNA, 24 nt, Human
cccuccgcugcgcccuccccgagc

SEQ ID NO: 1374362 - RNA, 24 nt, Human
cccucuuccaggagucugcccuau

SEQ ID NO: 1374363 - RNA, 21 nt, Human
cccugcccucccugcuugcaa

SEQ ID NO: 1374364 - RNA, 20 nt, Human
cccugugcaggccggccuuc

SEQ ID NO: 1374365 - RNA, 18 nt, Human
cccuugugaucugcuuag

SEQ ID NO: 1374366 - RNA, 25 nt, Human
ccgaaaaagcccauggacaacgaaa

SEQ ID NO: 1374367 - RNA, 22 nt, Human
ccgauuucucuccacucuagac

SEQ ID NO: 1374368 - RNA, 19 nt, Human
ccgcaggucuggcuggaug

SEQ ID NO: 1374369 - RNA, 21 nt, Human
ccgccccucuucugcccuuca

SEQ ID NO: 1374370 - RNA, 20 nt, Human
ccgcccgcgccuccgggucc

SEQ ID NO: 1374371 - RNA, 20 nt, Human
ccgcccgcgccuccgggucc

SEQ ID NO: 1374372 - RNA, 20 nt, Human
ccgccgcccccaguccgccc

SEQ ID NO: 1374373 - RNA, 18 nt, Human
ccgcucgcccuccgcugc

SEQ ID NO: 1374374 - RNA, 22 nt, Human
ccgcucgcccuccgcugcgccc

SEQ ID NO: 1374375 - RNA, 23 nt, Human
ccgcucgcccuccgcugcgcccu

SEQ ID NO: 1374376 - RNA, 20 nt, Human
ccgcugcgcccuccccgagc

SEQ ID NO: 1374377 - RNA, 18 nt, Human
ccggggcaggacccccag

SEQ ID NO: 1374378 - RNA, 18 nt, Human
ccuagaccuccguccuuu

SEQ ID NO: 1374379 - RNA, 18 nt, Human
ccuccaagccugcagccc

SEQ ID NO: 1374380 - RNA, 19 nt, Human
ccuccaagccugcagcccc

SEQ ID NO: 1374381 - RNA, 23 nt, Human
ccuccaagccugcagcccccauu

SEQ ID NO: 1374382 - RNA, 26 nt, Human
ccucccggaagcucccgccgccgcuu

SEQ ID NO: 1374383 - RNA, 20 nt, Human
ccuccgggcagcccucgccc

SEQ ID NO: 1374384 - RNA, 21 nt, Human
ccuccggguccuaacgccgcc

SEQ ID NO: 1374385 - RNA, 23 nt, Human
ccucuccucaucccaucccuggg

SEQ ID NO: 1374386 - RNA, 18 nt, Human
ccugcagcccccauuucc

SEQ ID NO: 1374387 - RNA, 22 nt, Human
ccugcagcccccauuuccagac

SEQ ID NO: 1374388 - RNA, 18 nt, Human
ccugcccucuccucaucc

SEQ ID NO: 1374389 - RNA, 18 nt, Human
ccugcgagccgcccuccc

SEQ ID NO: 1374390 - RNA, 21 nt, Human
ccugcgagccgcccucccgga

SEQ ID NO: 1374391 - RNA, 19 nt, Human
ccugcugaagaugucucca

SEQ ID NO: 1374392 - RNA, 18 nt, Human
ccugcuggaccugacccu

SEQ ID NO: 1374393 - RNA, 19 nt, Human
ccugcuugcaaguccccug

SEQ ID NO: 1374394 - RNA, 23 nt, Human
ccugucucuuccgugcaggagga

SEQ ID NO: 1374395 - RNA, 21 nt, Human
cgaggcuuagagggguugggu

SEQ ID NO: 1374396 - RNA, 24 nt, Human
cgcaaaacuacagauaucguauga

SEQ ID NO: 1374397 - RNA, 26 nt, Human
cgccaaaaauccagcgcugcccucag

SEQ ID NO: 1374398 - RNA, 18 nt, Human
cgccaggaauggggaagc

SEQ ID NO: 1374399 - RNA, 22 nt, Human
cgcccagggcccgccccugccc

SEQ ID NO: 1374400 - RNA, 22 nt, Human
cgcccccaguccgcccgcgccu

SEQ ID NO: 1374401 - RNA, 20 nt, Human
cgccuccggguccuaacgcc

SEQ ID NO: 1374402 - RNA, 21 nt, Human
cgcucugccggagccgcuggg

SEQ ID NO: 1374403 - RNA, 21 nt, Human
cggaacucacgcucacuccga

SEQ ID NO: 1374404 - RNA, 21 nt, Human
cggcagaccaccauacaccac

SEQ ID NO: 1374405 - RNA, 22 nt, Human
cuaacucacucaucccaacucu

SEQ ID NO: 1374406 - RNA, 22 nt, Human
cucacucauguuagauaaacac

SEQ ID NO: 1374407 - RNA, 21 nt, Human
cuccaagccugcagcccccau

SEQ ID NO: 1374408 - RNA, 24 nt, Human
cuccaagccugcagcccccauuuc

SEQ ID NO: 1374409 - RNA, 21 nt, Human
cuccacuacccaggaaaugcc

SEQ ID NO: 1374410 - RNA, 21 nt, Human
cuccagcccuacgccuugacc

SEQ ID NO: 1374411 - RNA, 22 nt, Human
cuccagcccuacgccuugaccc

SEQ ID NO: 1374412 - RNA, 18 nt, Human
cucccuacccugcccccc

SEQ ID NO: 1374413 - RNA, 21 nt, Human
cucggcuccuccgggcagccc

SEQ ID NO: 1374414 - RNA, 24 nt, Human
cucuccucaucccaucccugggca

SEQ ID NO: 1374415 - RNA, 19 nt, Human
cucucucccuucuuguccc

SEQ ID NO: 1374416 - RNA, 20 nt, Human
cucucucgcaggcuuagucc

SEQ ID NO: 1374417 - RNA, 19 nt, Human
cugaccugccagggagugc

SEQ ID NO: 1374418 - RNA, 18 nt, Human
cugagccaaggcaucaac

SEQ ID NO: 1374419 - RNA, 20 nt, Human
cugcagggcauccgccaucu

SEQ ID NO: 1374420 - RNA, 20 nt, Human
cugccccacacccugccagg

SEQ ID NO: 1374421 - RNA, 21 nt, Human
cugcccugccccacacccugc

SEQ ID NO: 1374422 - RNA, 24 nt, Human
cugcucuacugauugguuaauuuu

SEQ ID NO: 1374423 - RNA, 26 nt, Human
cugcuggaccugacccugugucaugu

SEQ ID NO: 1374424 - RNA, 19 nt, Human
cugcuuaguucccaccccc

SEQ ID NO: 1374425 - RNA, 22 nt, Human
cuggaauguucuucccaaccua

SEQ ID NO: 1374426 - RNA, 19 nt, Human
cuggagcccaaggacugug

SEQ ID NO: 1374427 - RNA, 24 nt, Human
cuggccccauuaauggauucuggg

SEQ ID NO: 1374428 - RNA, 18 nt, Human
cuguagccucaccccugu

SEQ ID NO: 1374429 - RNA, 23 nt, Human
cugucaccauuuccugucgucgu

SEQ ID NO: 1374430 - RNA, 18 nt, Human
cugugccucaguuuccuc

SEQ ID NO: 1374431 - RNA, 21 nt, Human
cuucccaugcagaagcacccc

SEQ ID NO: 1374432 - RNA, 22 nt, Human
cuucugugacggaugccugagg

SEQ ID NO: 1374433 - RNA, 23 nt, Human
cuuucaaucagcagggaccgugc

SEQ ID NO: 1374434 - RNA, 21 nt, Human
gaacccaggagugagggagcc

SEQ ID NO: 1374435 - RNA, 21 nt, Human
gaagcccacgcgguucaugcu

SEQ ID NO: 1374436 - RNA, 19 nt, Human
gaagucacuggagcccaag

SEQ ID NO: 1374437 - RNA, 18 nt, Human
gacagggcagggauggcu

SEQ ID NO: 1374438 - RNA, 19 nt, Human
gacccggagcgcuguccug

SEQ ID NO: 1374439 - RNA, 19 nt, Human
gaccuccguccuuuguccc

SEQ ID NO: 1374440 - RNA, 19 nt, Human
gaccugcauccucuucccu

SEQ ID NO: 1374441 - RNA, 22 nt, Human
gaccuugucuuuaccucugugg

SEQ ID NO: 1374442 - RNA, 20 nt, Human
gagcaggggcuccaggucug

SEQ ID NO: 1374443 - RNA, 24 nt, Human
gagcucccgacgugcacacggcuc

SEQ ID NO: 1374444 - RNA, 18 nt, Human
gaggaggagagguggcgg

SEQ ID NO: 1374445 - RNA, 20 nt, Human
gaguccaguuuugugaagug

SEQ ID NO: 1374446 - RNA, 19 nt, Human
gcaaagcucccucagcccc

SEQ ID NO: 1374447 - RNA, 24 nt, Human
gcaaagcucccucagccccauuca

SEQ ID NO: 1374448 - RNA, 25 nt, Human
gcaaagcucccucagccccauucaa

SEQ ID NO: 1374449 - RNA, 21 nt, Human
gcagacccucuuccuagaccu

SEQ ID NO: 1374450 - RNA, 23 nt, Human
gcauggugugggauccugggaag

SEQ ID NO: 1374451 - RNA, 22 nt, Human
gccaggaauggggaagcaaggc

SEQ ID NO: 1374452 - RNA, 18 nt, Human
gccccacacccugccagg

SEQ ID NO: 1374453 - RNA, 20 nt, Human
gcccucuccucaucccaucc

SEQ ID NO: 1374454 - RNA, 18 nt, Human
gccuaccugaccuugucu

SEQ ID NO: 1374455 - RNA, 19 nt, Human
gcgcggcuccaggaccccg

SEQ ID NO: 1374456 - RNA, 19 nt, Human
gcucagggccaagcugucc

SEQ ID NO: 1374457 - RNA, 18 nt, Human
gcugccuuccccucaagc

SEQ ID NO: 1374458 - RNA, 21 nt, Human
gcuuaguucccaccccccuuu

SEQ ID NO: 1374459 - RNA, 18 nt, Human
ggaaagcaaaaccaggcc

SEQ ID NO: 1374460 - RNA, 20 nt, Human
ggaaaugccuuccugcccuc

SEQ ID NO: 1374461 - RNA, 23 nt, Human
ggaacaaaugugaagcccaacau

SEQ ID NO: 1374462 - RNA, 22 nt, Human
ggaagggacagggcagggaugg

SEQ ID NO: 1374463 - RNA, 19 nt, Human
ggacacaaaggaaccaggg

SEQ ID NO: 1374464 - RNA, 21 nt, Human
ggacccccagcccacgcccag

SEQ ID NO: 1374465 - RNA, 21 nt, Human
ggaggagagagcacagccugc

SEQ ID NO: 1374466 - RNA, 22 nt, Human
ggcacuguuccauuccuuugca

SEQ ID NO: 1374467 - RNA, 20 nt, Human
ggccgggcugugcuggggcc

SEQ ID NO: 1374468 - RNA, 21 nt, Human
gggaaggagaccaagccucau

SEQ ID NO: 1374469 - RNA, 21 nt, Human
gggcagggauggcuuggacca

SEQ ID NO: 1374470 - RNA, 21 nt, Human
gggcauccgccaucugcugga

SEQ ID NO: 1374471 - RNA, 19 nt, Human
gggucuaccaugugaggca

SEQ ID NO: 1374472 - RNA, 18 nt, Human
guccuagccccgccgccc

SEQ ID NO: 1374473 - RNA, 19 nt, Human
gugacagaagaggaggcug

SEQ ID NO: 1374474 - RNA, 22 nt, Human
gugcauccagcaccacagaaaa

SEQ ID NO: 1374475 - RNA, 24 nt, Human
gugcgccccggggcaggaccccca

SEQ ID NO: 1374476 - RNA, 23 nt, Human
guggagcacaugguggagagaca

SEQ ID NO: 1374477 - RNA, 22 nt, Human
guucaggugaagaaagaccugg

SEQ ID NO: 1374478 - RNA, 26 nt, Human
guuuaaggggacggguucaaagcugg

SEQ ID NO: 1374479 - RNA, 25 nt, Human
uaaaaaucaagcguauaaauacaga

SEQ ID NO: 1374480 - RNA, 19 nt, Human
uaacaaucaaucucgcccu

SEQ ID NO: 1374481 - RNA, 18 nt, Human
uaagcucaguaggggcua

SEQ ID NO: 1374482 - RNA, 21 nt, Human
uacaccacguuccaagccaca

SEQ ID NO: 1374483 - RNA, 24 nt, Human
uacaccacguuccaagccacacug

SEQ ID NO: 1374484 - RNA, 18 nt, Human
uaccaaaaaaagagcaaa

SEQ ID NO: 1374485 - RNA, 22 nt, Human
uaccaaaaaaagagcaaacacc

SEQ ID NO: 1374486 - RNA, 22 nt, Human
uaccaaaaaaagagcaaacacu

SEQ ID NO: 1374487 - RNA, 22 nt, Human
uaccccaucuccccugaacaga

SEQ ID NO: 1374488 - RNA, 19 nt, Human
uacccgugcuuucugcucu

SEQ ID NO: 1374489 - RNA, 20 nt, Human
uagagaagccagacgcaaaa

SEQ ID NO: 1374490 - RNA, 25 nt, Human
uagagaagccagacgcaaaacuaca

SEQ ID NO: 1374491 - RNA, 20 nt, Human
uaguccccuggccccauuaa

SEQ ID NO: 1374492 - RNA, 18 nt, Human
uauccaccucccuacccu

SEQ ID NO: 1374493 - RNA, 20 nt, Human
ucaaagaggccuggcccaca

SEQ ID NO: 1374494 - RNA, 19 nt, Human
ucacagagacagaagcagu

SEQ ID NO: 1374495 - RNA, 19 nt, Human
uccaccuccaggcuguagu

SEQ ID NO: 1374496 - RNA, 18 nt, Human
uccagagaccuucugcag

SEQ ID NO: 1374497 - RNA, 21 nt, Human
uccagcaccacagaaaacaga

SEQ ID NO: 1374498 - RNA, 22 nt, Human
uccaggaccccgucgacccgga

SEQ ID NO: 1374499 - RNA, 22 nt, Human
ucccaucgcugccuuccccuca

SEQ ID NO: 1374500 - RNA, 21 nt, Human
uccccugaacagaugcaguaa

SEQ ID NO: 1374501 - RNA, 19 nt, Human
ucccuacccugccccccuc

SEQ ID NO: 1374502 - RNA, 19 nt, Human
ucccuacccugccccccuc

SEQ ID NO: 1374503 - RNA, 18 nt, Human
ucccucaauggccacucc

SEQ ID NO: 1374504 - RNA, 21 nt, Human
ucccuccaagccugcagcccc

SEQ ID NO: 1374505 - RNA, 23 nt, Human
ucccugaccugagaccaagccag

SEQ ID NO: 1374506 - RNA, 20 nt, Human
ucccugcuugcaaguccccu

SEQ ID NO: 1374507 - RNA, 21 nt, Human
uccuuugucccaucgcugcua

SEQ ID NO: 1374508 - RNA, 22 nt, Human
ucuacaaggugccaaguaccag

SEQ ID NO: 1374509 - RNA, 22 nt, Human
ucucagcccuucugugccucag

SEQ ID NO: 1374510 - RNA, 22 nt, Human
ucuccacucuagacccugagaa

SEQ ID NO: 1374511 - RNA, 18 nt, Human
ucucucagccuaccugac

SEQ ID NO: 1374512 - RNA, 18 nt, Human
ucugaccugccagggagu

SEQ ID NO: 1374513 - RNA, 19 nt, Human
ucugcagacccucuuccua

SEQ ID NO: 1374514 - RNA, 21 nt, Human
ucugcagacccucuuccuaga

SEQ ID NO: 1374515 - RNA, 21 nt, Human
ucuggaauguucuucccaacc

SEQ ID NO: 1374516 - RNA, 18 nt, Human
ucugucaccauuuccugu

SEQ ID NO: 1374517 - RNA, 20 nt, Human
ucuuaagguccagcacgagg

SEQ ID NO: 1374518 - RNA, 19 nt, Human
ucuuaccgauuucucucca

SEQ ID NO: 1374519 - RNA, 20 nt, Human
ucuucccaaccuacccacuc

SEQ ID NO: 1374520 - RNA, 22 nt, Human
ucuucugcccuucauccuucuu

SEQ ID NO: 1374521 - RNA, 21 nt, Human
ucuucugucccaucccugccc

SEQ ID NO: 1374522 - RNA, 22 nt, Human
ucuugaguaauccgugggcccu

SEQ ID NO: 1374523 - RNA, 20 nt, Human
ugaagaugucuccagagacc

SEQ ID NO: 1374524 - RNA, 22 nt, Human
ugaagucacuggagcccaagga

SEQ ID NO: 1374525 - RNA, 19 nt, Human
ugaccugagaccaagccag

SEQ ID NO: 1374526 - RNA, 22 nt, Human
ugacggcagugccugcucauga

SEQ ID NO: 1374527 - RNA, 22 nt, Human
ugacugucauccccuccagucu

SEQ ID NO: 1374528 - RNA, 23 nt, Human
ugagaagcccacgcgguucaugc

SEQ ID NO: 1374529 - RNA, 21 nt, Human
ugagaccaagccaggcuuccc

SEQ ID NO: 1374530 - RNA, 22 nt, Human
ugagaccaagccaggcuuccca

SEQ ID NO: 1374531 - RNA, 25 nt, Human
ugagaccaagccaggcuucccauga

SEQ ID NO: 1374532 - RNA, 21 nt, Human
ugaggacaucauuuuagcccu

SEQ ID NO: 1374533 - RNA, 22 nt, Human
ugaggcauggugugggauccug

SEQ ID NO: 1374534 - RNA, 18 nt, Human
ugaguccaguuuugugaa

SEQ ID NO: 1374535 - RNA, 21 nt, Human
ugagugaguguggcuucugga

SEQ ID NO: 1374536 - RNA, 18 nt, Human
ugagugcaagggagaggc

SEQ ID NO: 1374537 - RNA, 19 nt, Human
ugagugcaagggagaggca

SEQ ID NO: 1374538 - RNA, 19 nt, Human
ugaguggcagcacccaccu

SEQ ID NO: 1374539 - RNA, 21 nt, Human
ugcauauccaccucccuaccc

SEQ ID NO: 1374540 - RNA, 18 nt, Human
ugccaaguaccaggacag

SEQ ID NO: 1374541 - RNA, 21 nt, Human
ugccaggcacuguuccauucc

SEQ ID NO: 1374542 - RNA, 23 nt, Human
ugccccccucuuccaggagucug

SEQ ID NO: 1374543 - RNA, 18 nt, Human
ugccccugucucuuccgu

SEQ ID NO: 1374544 - RNA, 22 nt, Human
ugcccugccccacacccugcca

SEQ ID NO: 1374545 - RNA, 19 nt, Human
ugcgaggucagcacugcca

SEQ ID NO: 1374546 - RNA, 19 nt, Human
uggaaacuucuguuaacua

SEQ ID NO: 1374547 - RNA, 20 nt, Human
uggaacccaggagugaggga

SEQ ID NO: 1374548 - RNA, 21 nt, Human
uggagaacccacacucaauga

SEQ ID NO: 1374549 - RNA, 25 nt, Human
uggagcccaaggacugugcgagguc

SEQ ID NO: 1374550 - RNA, 20 nt, Human
uggaggaaguggggacacag

SEQ ID NO: 1374551 - RNA, 21 nt, Human
uggaggaaguggggacacagg

SEQ ID NO: 1374552 - RNA, 23 nt, Human
uggaguaagcacgugguuuuccu

SEQ ID NO: 1374553 - RNA, 22 nt, Human
uggcaaggaaacacaauuuccg

SEQ ID NO: 1374554 - RNA, 18 nt, Human
uggccccauuucccuugg

SEQ ID NO: 1374555 - RNA, 22 nt, Human
uggcucucccuucccuucaucc

SEQ ID NO: 1374556 - RNA, 19 nt, Human
ugggauagacaugaggacc

SEQ ID NO: 1374557 - RNA, 18 nt, Human
ugggaugagugagugugg

SEQ ID NO: 1374558 - RNA, 21 nt, Human
ugggcacagacgccagugagg

SEQ ID NO: 1374559 - RNA, 19 nt, Human
uggggccugagccgggugg

SEQ ID NO: 1374560 - RNA, 26 nt, Human
ugucucacccugcccucccugcuugc

SEQ ID NO: 1374561 - RNA, 19 nt, Human
ugucugggaaugcagccag

SEQ ID NO: 1374562 - RNA, 22 nt, Human
ugugacggaugccugaggaacc

SEQ ID NO: 1374563 - RNA, 22 nt, Human
uuaaaaaucaagcguauaaaua

SEQ ID NO: 1374564 - RNA, 23 nt, Human
uucacaaaugagaacaccgaggc

SEQ ID NO: 1374565 - RNA, 23 nt, Human
uuccaggagucugcccuaugugg

SEQ ID NO: 1374566 - RNA, 21 nt, Human
uucccaugacgagccucacag

SEQ ID NO: 1374567 - RNA, 18 nt, Human
uucccuaggugucccucg

SEQ ID NO: 1374568 - RNA, 19 nt, Human
uuggagaacccacacucaa

SEQ ID NO: 1374569 - RNA, 18 nt, Human
uuuaaaauaauucuacca

SEQ ID NO: 1374570 - RNA, 21 nt, Human
uuucaggaagagguggguucc

SEQ ID NO: 1374571 - RNA, 20 nt, Human
aaaaugagagcuccuuucca

SEQ ID NO: 1374572 - RNA, 23 nt, Human
aaacaggaaaaguauagcaccag

SEQ ID NO: 1374573 - RNA, 24 nt, Human
aaagaaagaagaaauguaugugaa

SEQ ID NO: 1374574 - RNA, 20 nt, Human
aaccucugccuccuaggcuc

SEQ ID NO: 1374575 - RNA, 22 nt, Human
aagagggcuucucagaggaggu

SEQ ID NO: 1374576 - RNA, 24 nt, Human
aaguaacccacccgcuuuggccuc

SEQ ID NO: 1374577 - RNA, 24 nt, Human
aaguagcuaagaucacaggcacac

SEQ ID NO: 1374578 - RNA, 24 nt, Human
aaguagcugggauuacaggcgugu

SEQ ID NO: 1374579 - RNA, 25 nt, Human
aaguagcugggauuacaggcgugug

SEQ ID NO: 1374580 - RNA, 19 nt, Human
aagugcugggauuagaggc

SEQ ID NO: 1374581 - RNA, 23 nt, Human
aauccccuccuccccgccccaga

SEQ ID NO: 1374582 - RNA, 20 nt, Human
acaccaccacguccggcuaa

SEQ ID NO: 1374583 - RNA, 22 nt, Human
acagugacggaagccaagcgcc

SEQ ID NO: 1374584 - RNA, 18 nt, Human
accacuauaucaagaaau

SEQ ID NO: 1374585 - RNA, 23 nt, Human
accucagccuaccaaguagcuaa

SEQ ID NO: 1374586 - RNA, 21 nt, Human
accucucaugguugugaaggu

SEQ ID NO: 1374587 - RNA, 24 nt, Human
acuccuggccucaaguaacccacc

SEQ ID NO: 1374588 - RNA, 18 nt, Human
acucugccaucugcuggc

SEQ ID NO: 1374589 - RNA, 25 nt, Human
acucuguugcccaggcuggagugca

SEQ ID NO: 1374590 - RNA, 22 nt, Human
agacaaaaaugcagggaaaacc

SEQ ID NO: 1374591 - RNA, 19 nt, Human
agacagugacggaagccaa

SEQ ID NO: 1374592 - RNA, 22 nt, Human
agagcuccuuuccauccugccu

SEQ ID NO: 1374593 - RNA, 22 nt, Human
agaucacaggcacacaccacca

SEQ ID NO: 1374594 - RNA, 24 nt, Human
agaugucaauguacuucccaaagc

SEQ ID NO: 1374595 - RNA, 24 nt, Human
agcaguuuugggaggcugaggcgg

SEQ ID NO: 1374596 - RNA, 24 nt, Human
agccugggcaauauagugagaccu

SEQ ID NO: 1374597 - RNA, 25 nt, Human
agccugggcaauauagugagaccuc

SEQ ID NO: 1374598 - RNA, 24 nt, Human
agcuacucaaaaggcugagguggg

SEQ ID NO: 1374599 - RNA, 23 nt, Human
agcuggauguggugguaaacacc

SEQ ID NO: 1374600 - RNA, 20 nt, Human
aggcacacaccaccacgucc

SEQ ID NO: 1374601 - RNA, 18 nt, Human
aggcaggguuuugucaug

SEQ ID NO: 1374602 - RNA, 24 nt, Human
aggcgugcgccaccaagcccugcu

SEQ ID NO: 1374603 - RNA, 22 nt, Human
aggcgugugccacugccuagcu

SEQ ID NO: 1374604 - RNA, 21 nt, Human
aggcugaggcgggaagauuac

SEQ ID NO: 1374605 - RNA, 24 nt, Human
aggcugaggcgggaagauuacuug

SEQ ID NO: 1374606 - RNA, 19 nt, Human
aggcugaggugggaggauc

SEQ ID NO: 1374607 - RNA, 18 nt, Human
aggcugaucucaaacucc

SEQ ID NO: 1374608 - RNA, 25 nt, Human
aggcuggagugcaguggugcaaucu

SEQ ID NO: 1374609 - RNA, 21 nt, Human
agugcaguggugcaaucucag

SEQ ID NO: 1374610 - RNA, 21 nt, Human
agugcaguggugcaaucucag

SEQ ID NO: 1374611 - RNA, 24 nt, Human
aguuuuguauuuuuuguagagaug

SEQ ID NO: 1374612 - RNA, 21 nt, Human
auccccuccuccccgccccag

SEQ ID NO: 1374613 - RNA, 23 nt, Human
augaugggagcagagaggagaaa

SEQ ID NO: 1374614 - RNA, 22 nt, Human
augccucagcuucccaaguagc

SEQ ID NO: 1374615 - RNA, 23 nt, Human
augcgcgcgcccucgaucacccc

SEQ ID NO: 1374616 - RNA, 23 nt, Human
augggguuuugccauguugccua

SEQ ID NO: 1374617 - RNA, 24 nt, Human
augggguuuugccauguugccuag

SEQ ID NO: 1374618 - RNA, 23 nt, Human
caaccucugccuccuaggcucaa

SEQ ID NO: 1374619 - RNA, 28 nt, Human
caagcaauucucaugccucagcuuccca

SEQ ID NO: 1374620 - RNA, 18 nt, Human
cacaccaccacguccggc

SEQ ID NO: 1374621 - RNA, 20 nt, Human
caccaaagaaagaagaaaug

SEQ ID NO: 1374622 - RNA, 22 nt, Human
caccucuacaaaaaauaagaaa

SEQ ID NO: 1374623 - RNA, 23 nt, Human
caccucuacaaaaaauaagaaaa

SEQ ID NO: 1374624 - RNA, 18 nt, Human
caccucuagucucagcua

SEQ ID NO: 1374625 - RNA, 19 nt, Human
caccucuagucucagcuac

SEQ ID NO: 1374626 - RNA, 22 nt, Human
cacucuguugcccaggcuggag

SEQ ID NO: 1374627 - RNA, 18 nt, Human
cacugcaaccucugccuc

SEQ ID NO: 1374628 - RNA, 21 nt, Human
cacugcaaccucugccuccua

SEQ ID NO: 1374629 - RNA, 24 nt, Human
cagaguuucacucuguugcccagg

SEQ ID NO: 1374630 - RNA, 24 nt, Human
cagcuacucaaaaggcugaggugg

SEQ ID NO: 1374631 - RNA, 20 nt, Human
caggaguuugagagcagccu

SEQ ID NO: 1374632 - RNA, 23 nt, Human
caggguuuugucauguuggccag

SEQ ID NO: 1374633 - RNA, 24 nt, Human
caggguuuugucauguuggccagg

SEQ ID NO: 1374634 - RNA, 18 nt, Human
cauguuggccaggcugau

SEQ ID NO: 1374635 - RNA, 21 nt, Human
cauguuggccaggcugaucuc

SEQ ID NO: 1374636 - RNA, 24 nt, Human
cauguuggccaggcugaucucaaa

SEQ ID NO: 1374637 - RNA, 20 nt, Human
cauucccucaacucccgacc

SEQ ID NO: 1374638 - RNA, 26 nt, Human
cauuugcuguccuggaauacugggga

SEQ ID NO: 1374639 - RNA, 19 nt, Human
ccaaagaaagaagaaaugu

SEQ ID NO: 1374640 - RNA, 23 nt, Human
ccaagccucgaauugaagaaugg

SEQ ID NO: 1374641 - RNA, 22 nt, Human
ccaaguagcugggauuacaggc

SEQ ID NO: 1374642 - RNA, 24 nt, Human
ccaaguagcugggauuacaggcgu

SEQ ID NO: 1374643 - RNA, 23 nt, Human
ccagacagugacggaagccaagc

SEQ ID NO: 1374644 - RNA, 19 nt, Human
ccauguugccuagggugcc

SEQ ID NO: 1374645 - RNA, 20 nt, Human
ccauguugccuagggugccu

SEQ ID NO: 1374646 - RNA, 23 nt, Human
cccaaguagcugggauuacaggc

SEQ ID NO: 1374647 - RNA, 24 nt, Human
cccaaguagcugggauuacaggcg

SEQ ID NO: 1374648 - RNA, 23 nt, Human
cccaccucagccuaccaaguagc

SEQ ID NO: 1374649 - RNA, 24 nt, Human
cccacuguagccucgaaguccugg

SEQ ID NO: 1374650 - RNA, 22 nt, Human
cccgcuaagaggaagacaaaaa

SEQ ID NO: 1374651 - RNA, 23 nt, Human
cccgcuaagaggaagacaaaaau

SEQ ID NO: 1374652 - RNA, 20 nt, Human
cccucaacucccgaccuggg

SEQ ID NO: 1374653 - RNA, 21 nt, Human
cccuuggggaagaggggagga

SEQ ID NO: 1374654 - RNA, 19 nt, Human
ccgcuaagaggaagacaaa

SEQ ID NO: 1374655 - RNA, 26 nt, Human
ccucccaccucagccuaccaaguagc

SEQ ID NO: 1374656 - RNA, 25 nt, Human
ccucccauaagugcugggauuagag

SEQ ID NO: 1374657 - RNA, 19 nt, Human
ccuccccgccccagaaccu

SEQ ID NO: 1374658 - RNA, 23 nt, Human
ccuccccgccccagaaccuagac

SEQ ID NO: 1374659 - RNA, 19 nt, Human
ccucgaauugaagaauggg

SEQ ID NO: 1374660 - RNA, 24 nt, Human
ccucuagucucagcuacucaaaag

SEQ ID NO: 1374661 - RNA, 18 nt, Human
ccugccuuccccuuucuu

SEQ ID NO: 1374662 - RNA, 22 nt, Human
ccuggccucaaguaacccaccc

SEQ ID NO: 1374663 - RNA, 23 nt, Human
ccuggccucaaguaacccacccg

SEQ ID NO: 1374664 - RNA, 20 nt, Human
ccuuggggaagaggggagga

SEQ ID NO: 1374665 - RNA, 19 nt, Human
cgaauugaagaaugggcac

SEQ ID NO: 1374666 - RNA, 22 nt, Human
cgugugccacugccuagcuaau

SEQ ID NO: 1374667 - RNA, 18 nt, Human
cucaaaaggcugaggugg

SEQ ID NO: 1374668 - RNA, 19 nt, Human
cucaagcaauucucaugcc

SEQ ID NO: 1374669 - RNA, 24 nt, Human
cucacugcaaccucugccuccuag

SEQ ID NO: 1374670 - RNA, 24 nt, Human
cucagcuucccaaguagcugggau

SEQ ID NO: 1374671 - RNA, 23 nt, Human
cuccuaggcucaagcaauucuca

SEQ ID NO: 1374672 - RNA, 20 nt, Human
cucuacaaaaaauaagaaaa

SEQ ID NO: 1374673 - RNA, 20 nt, Human
cucugucacccaagcuagag

SEQ ID NO: 1374674 - RNA, 19 nt, Human
cugcaaccucugccuccua

SEQ ID NO: 1374675 - RNA, 23 nt, Human
cugcaaccucugccuccuaggcu

SEQ ID NO: 1374676 - RNA, 21 nt, Human
cuggauguggugguaaacacc

SEQ ID NO: 1374677 - RNA, 23 nt, Human
cuuucucuuuucuugggcaggcc

SEQ ID NO: 1374678 - RNA, 22 nt, Human
gaagccaagcgcccgcuaagag

SEQ ID NO: 1374679 - RNA, 19 nt, Human
gaccugggaagggggaggc

SEQ ID NO: 1374680 - RNA, 20 nt, Human
gagaaaauguaauuugagug

SEQ ID NO: 1374681 - RNA, 18 nt, Human
gagaugggguuuugccau

SEQ ID NO: 1374682 - RNA, 20 nt, Human
gagcagccugggcaauauag

SEQ ID NO: 1374683 - RNA, 28 nt, Human
gagcuuccagacagggcagagagacucu

SEQ ID NO: 1374684 - RNA, 19 nt, Human
gaggagguggccaagccuc

SEQ ID NO: 1374685 - RNA, 20 nt, Human
gaggaucaaaaacaaaaaaa

SEQ ID NO: 1374686 - RNA, 24 nt, Human
gaguugucguugcggauugucuug

SEQ ID NO: 1374687 - RNA, 18 nt, Human
gauuacaggcgugugcca

SEQ ID NO: 1374688 - RNA, 22 nt, Human
gauuacaggcgugugccacugc

SEQ ID NO: 1374689 - RNA, 22 nt, Human
gauuacuugagcucaggaguuu

SEQ ID NO: 1374690 - RNA, 24 nt, Human
gauuacuugagcucaggaguuuga

SEQ ID NO: 1374691 - RNA, 22 nt, Human
gcaaccucugccuccuaggcuc

SEQ ID NO: 1374692 - RNA, 20 nt, Human
gcagggaaaaccucggaggu

SEQ ID NO: 1374693 - RNA, 23 nt, Human
gcaggguuuugucauguuggcca

SEQ ID NO: 1374694 - RNA, 19 nt, Human
gcccaggcuggagugcagu

SEQ ID NO: 1374695 - RNA, 20 nt, Human
gcccaggcuggagugcagug

SEQ ID NO: 1374696 - RNA, 24 nt, Human
gccccucuuggaaaccucccccau

SEQ ID NO: 1374697 - RNA, 24 nt, Human
gccucagcuucccaaguagcuggg

SEQ ID NO: 1374698 - RNA, 25 nt, Human
gcucugucacccaagcuagagugca

SEQ ID NO: 1374699 - RNA, 23 nt, Human
gcugaucucaaacuccuggccuc

SEQ ID NO: 1374700 - RNA, 28 nt, Human
ggaaaccucccccauucccucaacuccc

SEQ ID NO: 1374701 - RNA, 24 nt, Human
ggccucaaguaacccacccgcuuu

SEQ ID NO: 1374702 - RNA, 23 nt, Human
ggcugaagguaagcgggcgaugc

SEQ ID NO: 1374703 - RNA, 18 nt, Human
gggagggcccuuggggaa

SEQ ID NO: 1374704 - RNA, 19 nt, Human
gggguuuugccauguugcc

SEQ ID NO: 1374705 - RNA, 23 nt, Human
gggguuuugccauguugccuagg

SEQ ID NO: 1374706 - RNA, 21 nt, Human
ggguuuugucauguuggccag

SEQ ID NO: 1374707 - RNA, 22 nt, Human
ggguuuugucauguuggccagg

SEQ ID NO: 1374708 - RNA, 24 nt, Human
guaacccacccgcuuuggccuccc

SEQ ID NO: 1374709 - RNA, 19 nt, Human
guagagaugggguuuugcc

SEQ ID NO: 1374710 - RNA, 21 nt, Human
guagagaugggguuuugccau

SEQ ID NO: 1374711 - RNA, 22 nt, Human
guagagaugggguuuugccaug

SEQ ID NO: 1374712 - RNA, 21 nt, Human
guagaggcaggguuuugucau

SEQ ID NO: 1374713 - RNA, 19 nt, Human
guaggcaccaaagaaagaa

SEQ ID NO: 1374714 - RNA, 19 nt, Human
guauuuuuuguagagaugg

SEQ ID NO: 1374715 - RNA, 18 nt, Human
gucauguuggccaggcug

SEQ ID NO: 1374716 - RNA, 23 nt, Human
gugaggccuguggguucugggag

SEQ ID NO: 1374717 - RNA, 21 nt, Human
gugggaggaucaaaaacaaaa

SEQ ID NO: 1374718 - RNA, 22 nt, Human
guuaucucuuuucuuuucuuug

SEQ ID NO: 1374719 - RNA, 21 nt, Human
guucugggagggcccuugggg

SEQ ID NO: 1374720 - RNA, 24 nt, Human
guuucacucuguugcccaggcugg

SEQ ID NO: 1374721 - RNA, 21 nt, Human
uaaauccccuccuccccgccc

SEQ ID NO: 1374722 - RNA, 24 nt, Human
uaagaucacaggcacacaccacca

SEQ ID NO: 1374723 - RNA, 24 nt, Human
uaaguuuuguauuuuuuguagaga

SEQ ID NO: 1374724 - RNA, 24 nt, Human
uacaaaucaaacaaucugaagcau

SEQ ID NO: 1374725 - RNA, 21 nt, Human
uacacaaaacauauuuguggu

SEQ ID NO: 1374726 - RNA, 20 nt, Human
uaccaaguagcuaagaucac

SEQ ID NO: 1374727 - RNA, 22 nt, Human
uagagaugggguuuugccaugu

SEQ ID NO: 1374728 - RNA, 21 nt, Human
uagaggcaggguuuugucaug

SEQ ID NO: 1374729 - RNA, 23 nt, Human
uagagugcaguggugcaaucuca

SEQ ID NO: 1374730 - RNA, 24 nt, Human
uagagugcaguggugcaaucucag

SEQ ID NO: 1374731 - RNA, 18 nt, Human
uagcaccaggucggaggg

SEQ ID NO: 1374732 - RNA, 23 nt, Human
uaguauagauaugccguaauuuu

SEQ ID NO: 1374733 - RNA, 21 nt, Human
uauagugagaccucaccucua

SEQ ID NO: 1374734 - RNA, 20 nt, Human
uaucaagaaauaggagcuuc

SEQ ID NO: 1374735 - RNA, 23 nt, Human
uauuuuuuaaaacacuauuuaua

SEQ ID NO: 1374736 - RNA, 25 nt, Human
ucaagccauccucccaccucagccu

SEQ ID NO: 1374737 - RNA, 22 nt, Human
ucaccuaaacauaucucuuggu

SEQ ID NO: 1374738 - RNA, 21 nt, Human
ucacucuguugcccaggcugg

SEQ ID NO: 1374739 - RNA, 22 nt, Human
ucacucuguugcccaggcugga

SEQ ID NO: 1374740 - RNA, 24 nt, Human
ucacucuguugcccaggcuggagu

SEQ ID NO: 1374741 - RNA, 19 nt, Human
ucacugcaaccucugccuc

SEQ ID NO: 1374742 - RNA, 24 nt, Human
ucacugcaaccucugccuccuagg

SEQ ID NO: 1374743 - RNA, 25 nt, Human
ucacugcaaccucugccuccuaggc

SEQ ID NO: 1374744 - RNA, 27 nt, Human
ucacugcaaccucugccuccuaggcuc

SEQ ID NO: 1374745 - RNA, 27 nt, Human
ucagcucacugcaaccucugccuccua

SEQ ID NO: 1374746 - RNA, 21 nt, Human
ucaggguaucauuuuggguga

SEQ ID NO: 1374747 - RNA, 27 nt, Human
ucaguugggcuguaaucccagcaguuu

SEQ ID NO: 1374748 - RNA, 24 nt, Human
ucccaaguagcugggauuacaggc

SEQ ID NO: 1374749 - RNA, 20 nt, Human
ucccccauucccucaacucc

SEQ ID NO: 1374750 - RNA, 21 nt, Human
uccuaggcucaagcaauucuc

SEQ ID NO: 1374751 - RNA, 24 nt, Human
uccuaggcucaagcaauucucaug

SEQ ID NO: 1374752 - RNA, 19 nt, Human
uccugccuuccccuuucuu

SEQ ID NO: 1374753 - RNA, 22 nt, Human
uccuggaauacuggggaagggc

SEQ ID NO: 1374754 - RNA, 18 nt, Human
uccuggauucaagccauc

SEQ ID NO: 1374755 - RNA, 22 nt, Human
ucucuuggugauccuuuacauu

SEQ ID NO: 1374756 - RNA, 24 nt, Human
ucugucacccaagcuagagugcag

SEQ ID NO: 1374757 - RNA, 18 nt, Human
ucuguugcccaggcugga

SEQ ID NO: 1374758 - RNA, 24 nt, Human
ucuguugcccaggcuggagugcag

SEQ ID NO: 1374759 - RNA, 18 nt, Human
ucuugcucugucacccaa

SEQ ID NO: 1374760 - RNA, 24 nt, Human
ucuugcucugucacccaagcuaga

SEQ ID NO: 1374761 - RNA, 22 nt, Human
ugagacagaguuucacucuguu

SEQ ID NO: 1374762 - RNA, 19 nt, Human
ugagagugggaaaggggcc

SEQ ID NO: 1374763 - RNA, 22 nt, Human
ugaggugggaggaucaaaaaca

SEQ ID NO: 1374764 - RNA, 21 nt, Human
ugcagggaaaaccucggaggu

SEQ ID NO: 1374765 - RNA, 22 nt, Human
ugcaguggugcaaucucagcuc

SEQ ID NO: 1374766 - RNA, 21 nt, Human
ugccauguugccuagggugcc

SEQ ID NO: 1374767 - RNA, 18 nt, Human
ugcccaggcuggagugca

SEQ ID NO: 1374768 - RNA, 21 nt, Human
ugcccaggcuggagugcagug

SEQ ID NO: 1374769 - RNA, 24 nt, Human
ugcccaggcuggagugcaguggug

SEQ ID NO: 1374770 - RNA, 22 nt, Human
ugccucagcuucccaaguagcu

SEQ ID NO: 1374771 - RNA, 24 nt, Human
ugccucagcuucccaaguagcugg

SEQ ID NO: 1374772 - RNA, 18 nt, Human
uggagugcaguggugcaa

SEQ ID NO: 1374773 - RNA, 23 nt, Human
uggagugcaguggugcaaucuca

SEQ ID NO: 1374774 - RNA, 24 nt, Human
uggagugcaguggugcaaucucag

SEQ ID NO: 1374775 - RNA, 24 nt, Human
uggccaggcugaucucaaacuccu

SEQ ID NO: 1374776 - RNA, 23 nt, Human
uggccucaaguaacccacccgcu

SEQ ID NO: 1374777 - RNA, 27 nt, Human
uggcucugugacccuggacaaggggcc

SEQ ID NO: 1374778 - RNA, 20 nt, Human
ugggaggcugaggcgggaag

SEQ ID NO: 1374779 - RNA, 22 nt, Human
ugggaggcugaggcgggaagau

SEQ ID NO: 1374780 - RNA, 21 nt, Human
ugggauuacaggcgugugcca

SEQ ID NO: 1374781 - RNA, 22 nt, Human
ugggauuacaggcgugugccac

SEQ ID NO: 1374782 - RNA, 22 nt, Human
ugggauuacaggcgugugccac

SEQ ID NO: 1374783 - RNA, 22 nt, Human
ugggauuacaggcgugugccac

SEQ ID NO: 1374784 - RNA, 24 nt, Human
ugggauuacaggcgugugccacug

SEQ ID NO: 1374785 - RNA, 22 nt, Human
ugggauuagaggcgugcgccac

SEQ ID NO: 1374786 - RNA, 24 nt, Human
ugggauuagaggcgugcgccacca

SEQ ID NO: 1374787 - RNA, 22 nt, Human
uggggaagaggggaggagaggu

SEQ ID NO: 1374788 - RNA, 24 nt, Human
ugggguuuugccauguugccuagg

SEQ ID NO: 1374789 - RNA, 24 nt, Human
uggugcaaucucagcccacuguag

SEQ ID NO: 1374790 - RNA, 24 nt, Human
uggugcaaucucagcucacugcaa

SEQ ID NO: 1374791 - RNA, 23 nt, Human
uggugguaaacaccucuagucuc

SEQ ID NO: 1374792 - RNA, 24 nt, Human
uguagagaugggguuuugccaugu

SEQ ID NO: 1374793 - RNA, 24 nt, Human
ugucauguuggccaggcugaucuc

SEQ ID NO: 1374794 - RNA, 26 nt, Human
ugucauguuggccaggcugaucucaa

SEQ ID NO: 1374795 - RNA, 19 nt, Human
uuaaaguagaugucaaugu

SEQ ID NO: 1374796 - RNA, 24 nt, Human
uuacacaaaacauauuugugguuc

SEQ ID NO: 1374797 - RNA, 21 nt, Human
uuacuugagcucaggaguuug

SEQ ID NO: 1374798 - RNA, 18 nt, Human
uuagcuggaugugguggu

SEQ ID NO: 1374799 - RNA, 25 nt, Human
uucaagccauccucccaccucagcc

SEQ ID NO: 1374800 - RNA, 23 nt, Human
uucacucuguugcccaggcugga

SEQ ID NO: 1374801 - RNA, 24 nt, Human
uucacucuguugcccaggcuggag

SEQ ID NO: 1374802 - RNA, 20 nt, Human
uugaagaaugggcacggcug

SEQ ID NO: 1374803 - RNA, 22 nt, Human
uugggaggcugaggcgggaaga

SEQ ID NO: 1374804 - RNA, 21 nt, Human
uuggggaagaggggaggagag

SEQ ID NO: 1374805 - RNA, 24 nt, Human
uuguagagaugggguuuugccaug

SEQ ID NO: 1374806 - RNA, 24 nt, Human
uuguagaggcaggguuuugucaug

SEQ ID NO: 1374807 - RNA, 22 nt, Human
uuucacucuguugcccaggcug

SEQ ID NO: 1374808 - RNA, 23 nt, Human
uuucacucuguugcccaggcugg

SEQ ID NO: 1374809 - RNA, 24 nt, Human
uuucacucuguugcccaggcugga

SEQ ID NO: 1374810 - RNA, 20 nt, Human
uuucucaucuguacaauagg

SEQ ID NO: 1374811 - RNA, 24 nt, Human
uuucucuuuucuugggcaggccuu

SEQ ID NO: 1374812 - RNA, 24 nt, Human
uuuguagagaugggguuuugccau

SEQ ID NO: 1374813 - RNA, 20 nt, Human
uuuguagaggcaggguuuug

SEQ ID NO: 1374814 - RNA, 24 nt, Human
uuuguagaggcaggguuuugucau

SEQ ID NO: 1374815 - RNA, 19 nt, Human
uuuucuuuucuuuguuucu

SEQ ID NO: 1374816 - RNA, 19 nt, Human
uuuugccauguugccuagg

SEQ ID NO: 1374817 - RNA, 24 nt, Human
uuuuuuguagagaugggguuuugc

SEQ ID NO: 1374818 - RNA, 21 nt, Human
uuuuuuguagaggcaggguuu

SEQ ID NO: 1374819 - RNA, 21 nt, Human
uuuuuuguagaggcaggguuu

SEQ ID NO: 1374820 - RNA, 22 nt, Human
aaacacucuuccacuugguuuc

SEQ ID NO: 1374821 - RNA, 18 nt, Human
aaccuguuuacaugcaca

SEQ ID NO: 1374822 - RNA, 22 nt, Human
aaggaggcaucacacaaggaaa

SEQ ID NO: 1374823 - RNA, 23 nt, Human
acaacaaggaagauaaagaggaa

SEQ ID NO: 1374824 - RNA, 18 nt, Human
acaaggaaagccccaccc

SEQ ID NO: 1374825 - RNA, 20 nt, Human
acaaggaaagccccaccccc

SEQ ID NO: 1374826 - RNA, 21 nt, Human
auggagucuuuggggcggucc

SEQ ID NO: 1374827 - RNA, 22 nt, Human
caaaauuagcagcaaugcugag

SEQ ID NO: 1374828 - RNA, 25 nt, Human
caaaguacuugagacauugccugug

SEQ ID NO: 1374829 - RNA, 21 nt, Human
caacaaggaagauaaagagga

SEQ ID NO: 1374830 - RNA, 18 nt, Human
cacaacaaggaagauaaa

SEQ ID NO: 1374831 - RNA, 19 nt, Human
cacacaaggaaagccccac

SEQ ID NO: 1374832 - RNA, 19 nt, Human
cagaaacuagcaggaccaa

SEQ ID NO: 1374833 - RNA, 20 nt, Human
caggcccaagggaaggggcu

SEQ ID NO: 1374834 - RNA, 22 nt, Human
caggcccaagggaaggggcuag

SEQ ID NO: 1374835 - RNA, 20 nt, Human
ccaaagcaguggaaauucau

SEQ ID NO: 1374836 - RNA, 21 nt, Human
ccccgggccucccguagccuu

SEQ ID NO: 1374837 - RNA, 23 nt, Human
ccuaaggucaaaguacuugagac

SEQ ID NO: 1374838 - RNA, 21 nt, Human
ccuucuacccuaaggucaaag

SEQ ID NO: 1374839 - RNA, 20 nt, Human
cgcaagcgccccgggccucc

SEQ ID NO: 1374840 - RNA, 20 nt, Human
cgccccgggccucccguagc

SEQ ID NO: 1374841 - RNA, 22 nt, Human
cugagcaaaggaaccuguuuac

SEQ ID NO: 1374842 - RNA, 19 nt, Human
gaaagccccacccccuacu

SEQ ID NO: 1374843 - RNA, 19 nt, Human
gagacauuuacuggcagcu

SEQ ID NO: 1374844 - RNA, 19 nt, Human
gaggcaucacacaaggaaa

SEQ ID NO: 1374845 - RNA, 19 nt, Human
gccccgggccucccguagc

SEQ ID NO: 1374846 - RNA, 24 nt, Human
gccuugauggucugcugcuuccgu

SEQ ID NO: 1374847 - RNA, 20 nt, Human
ggcagcuuugccuucuaccc

SEQ ID NO: 1374848 - RNA, 19 nt, Human
ggcuaggauucggcugacu

SEQ ID NO: 1374849 - RNA, 22 nt, Human
gggccucccguagccuugaugg

SEQ ID NO: 1374850 - RNA, 24 nt, Human
gucacugaugucgagcaccacagc

SEQ ID NO: 1374851 - RNA, 24 nt, Human
gugugccuaaggaggcaucacaca

SEQ ID NO: 1374852 - RNA, 19 nt, Human
uaaggaggcaucacacaag

SEQ ID NO: 1374853 - RNA, 20 nt, Human
uacaacacauuuauuuguac

SEQ ID NO: 1374854 - RNA, 26 nt, Human
uaggauucggcugacucagguccauc

SEQ ID NO: 1374855 - RNA, 21 nt, Human
uccagaaacuagcaggaccaa

SEQ ID NO: 1374856 - RNA, 19 nt, Human
ugacucagguccaucccau

SEQ ID NO: 1374857 - RNA, 21 nt, Human
ugacucagguccaucccaugg

SEQ ID NO: 1374858 - RNA, 21 nt, Human
ugaugucgagcaccacagcag

SEQ ID NO: 1374859 - RNA, 18 nt, Human
uuuacuggcagcuuugcc

SEQ ID NO: 1374860 - RNA, 21 nt, Human
aaacagaaacguccaccaagg

SEQ ID NO: 1374861 - RNA, 23 nt, Human
aaauagcccugcaaccagccgga

SEQ ID NO: 1374862 - RNA, 19 nt, Human
aaauguuacaggcugaugc

SEQ ID NO: 1374863 - RNA, 25 nt, Human
aacaucacagucccaaucucagaac

SEQ ID NO: 1374864 - RNA, 18 nt, Human
aacaugggccugcaugca

SEQ ID NO: 1374865 - RNA, 20 nt, Human
aagaagaggcagcccacagc

SEQ ID NO: 1374866 - RNA, 24 nt, Human
aagagaaaaggagucuggucuguu

SEQ ID NO: 1374867 - RNA, 24 nt, Human
aaggaaagagaagaaauguuacag

SEQ ID NO: 1374868 - RNA, 19 nt, Human
aauacacagcuaaagaggg

SEQ ID NO: 1374869 - RNA, 18 nt, Human
acaaaccacaccccuucc

SEQ ID NO: 1374870 - RNA, 23 nt, Human
acacacacgcacguacacacaca

SEQ ID NO: 1374871 - RNA, 20 nt, Human
acacagcuaaagagggggaa

SEQ ID NO: 1374872 - RNA, 32 nt, Human
acacaggaacacacacacacacgcacguacag

SEQ ID NO: 1374873 - RNA, 23 nt, Human
acagaaagggugggugaaaaucg

SEQ ID NO: 1374874 - RNA, 20 nt, Human
acagaagacgccagcucaca

SEQ ID NO: 1374875 - RNA, 20 nt, Human
acagccaacucuccuacaua

SEQ ID NO: 1374876 - RNA, 23 nt, Human
accaaggaggacaugggcaggac

SEQ ID NO: 1374877 - RNA, 22 nt, Human
acccugcaccuauaucugcuac

SEQ ID NO: 1374878 - RNA, 20 nt, Human
acucugauaaccuccuacca

SEQ ID NO: 1374879 - RNA, 23 nt, Human
agaagacgccagcucacacucuu

SEQ ID NO: 1374880 - RNA, 20 nt, Human
agaagagaaaaggagucugg

SEQ ID NO: 1374881 - RNA, 21 nt, Human
agaggaggaagggcuuccucc

SEQ ID NO: 1374882 - RNA, 18 nt, Human
agauucugggcuggcugc

SEQ ID NO: 1374883 - RNA, 23 nt, Human
agcagaugcagccucacacuccc

SEQ ID NO: 1374884 - RNA, 18 nt, Human
agcagcauuuggaggaca

SEQ ID NO: 1374885 - RNA, 22 nt, Human
agccaagagugccgaggaccca

SEQ ID NO: 1374886 - RNA, 24 nt, Human
aggaaagagaagaaauguuacagg

SEQ ID NO: 1374887 - RNA, 21 nt, Human
aggagcagggucacagagcuc

SEQ ID NO: 1374888 - RNA, 18 nt, Human
aggaggaggugcacugcc

SEQ ID NO: 1374889 - RNA, 18 nt, Human
aggcugaaacaugggccu

SEQ ID NO: 1374890 - RNA, 19 nt, Human
aggggcagaugcugaggcu

SEQ ID NO: 1374891 - RNA, 18 nt, Human
aucaauggccuucugaaa

SEQ ID NO: 1374892 - RNA, 20 nt, Human
auccaugugcaaaccccaag

SEQ ID NO: 1374893 - RNA, 21 nt, Human
auggugacaacugcuaggcag

SEQ ID NO: 1374894 - RNA, 19 nt, Human
caaaacaggaucuacgaac

SEQ ID NO: 1374895 - RNA, 21 nt, Human
caaaggaaagagaagaaaugu

SEQ ID NO: 1374896 - RNA, 22 nt, Human
caauagagcuggugucguccca

SEQ ID NO: 1374897 - RNA, 26 nt, Human
cacacacacgugcacaaauacacagc

SEQ ID NO: 1374898 - RNA, 25 nt, Human
cacacaggcacguaacauacacagu

SEQ ID NO: 1374899 - RNA, 19 nt, Human
cacagucccaaucucagaa

SEQ ID NO: 1374900 - RNA, 19 nt, Human
caccaaggaggacaugggc

SEQ ID NO: 1374901 - RNA, 23 nt, Human
cacccugcaccuauaucugcuac

SEQ ID NO: 1374902 - RNA, 24 nt, Human
cacccuucccucggcccggugcac

SEQ ID NO: 1374903 - RNA, 19 nt, Human
cacgguuucccuuugcucc

SEQ ID NO: 1374904 - RNA, 20 nt, Human
cacguucucacggccagggg

SEQ ID NO: 1374905 - RNA, 25 nt, Human
cacuuugguaacuucuaagccugag

SEQ ID NO: 1374906 - RNA, 19 nt, Human
cagaagacagggccucugc

SEQ ID NO: 1374907 - RNA, 18 nt, Human
cagaagacgccagcucac

SEQ ID NO: 1374908 - RNA, 19 nt, Human
cagagcccgaacuuggaac

SEQ ID NO: 1374909 - RNA, 22 nt, Human
cagagcccgaacuuggaaccag

SEQ ID NO: 1374910 - RNA, 21 nt, Human
cagcaccauuuauguccucug

SEQ ID NO: 1374911 - RNA, 24 nt, Human
cagcagcacaacauaaauaaugcc

SEQ ID NO: 1374912 - RNA, 21 nt, Human
cagccggacuuacugucuaaa

SEQ ID NO: 1374913 - RNA, 20 nt, Human
cagcucuccuggcuuuggaa

SEQ ID NO: 1374914 - RNA, 30 nt, Human
caggaacacacacacacacgcacguacaca

SEQ ID NO: 1374915 - RNA, 21 nt, Human
caggagcacaagccagagauc

SEQ ID NO: 1374916 - RNA, 24 nt, Human
caggauggucucuagcagcucuga

SEQ ID NO: 1374917 - RNA, 23 nt, Human
cagggccucugcuacucccggcu

SEQ ID NO: 1374918 - RNA, 22 nt, Human
caguguggggccgggcacuggu

SEQ ID NO: 1374919 - RNA, 21 nt, Human
cauagccaggaagguccucug

SEQ ID NO: 1374920 - RNA, 25 nt, Human
caugcacacagccccauuuuauacg

SEQ ID NO: 1374921 - RNA, 21 nt, Human
caugcuggaagugcacaucca

SEQ ID NO: 1374922 - RNA, 24 nt, Human
caugggcaggacacaggucuggcc

SEQ ID NO: 1374923 - RNA, 23 nt, Human
cauuuauguccucuggccaggga

SEQ ID NO: 1374924 - RNA, 18 nt, Human
ccaaaucugaaggcugac

SEQ ID NO: 1374925 - RNA, 23 nt, Human
ccaacaucacagucccaaucuca

SEQ ID NO: 1374926 - RNA, 25 nt, Human
ccacugaaagagcauagcuuccccc

SEQ ID NO: 1374927 - RNA, 23 nt, Human
ccagaaauccuaaagcuacagcc

SEQ ID NO: 1374928 - RNA, 21 nt, Human
ccagcagaugcagccucacac

SEQ ID NO: 1374929 - RNA, 21 nt, Human
ccagcaggggcagaugcugag

SEQ ID NO: 1374930 - RNA, 22 nt, Human
ccauacauuucugcaguccuuc

SEQ ID NO: 1374931 - RNA, 18 nt, Human
cccaacaucacaguccca

SEQ ID NO: 1374932 - RNA, 24 nt, Human
cccacuacuacugacuggcugacc

SEQ ID NO: 1374933 - RNA, 19 nt, Human
ccccaguauucuaccaucc

SEQ ID NO: 1374934 - RNA, 23 nt, Human
ccccaguauucuaccauccaguc

SEQ ID NO: 1374935 - RNA, 24 nt, Human
cccccagaaucacuuugauuuaaa

SEQ ID NO: 1374936 - RNA, 22 nt, Human
cccgaacuuggaaccaggagau

SEQ ID NO: 1374937 - RNA, 19 nt, Human
ccgcucccaacagcagcag

SEQ ID NO: 1374938 - RNA, 20 nt, Human
ccuaaggaagaacaagucaa

SEQ ID NO: 1374939 - RNA, 19 nt, Human
ccucaggucccaacaucac

SEQ ID NO: 1374940 - RNA, 19 nt, Human
ccugcauagccaggaaggu

SEQ ID NO: 1374941 - RNA, 20 nt, Human
ccuucaaccagcuuucagag

SEQ ID NO: 1374942 - RNA, 24 nt, Human
ccuuugcuccguugcucugugauc

SEQ ID NO: 1374943 - RNA, 25 nt, Human
cgaaacacagaagcaaaaccccuga

SEQ ID NO: 1374944 - RNA, 23 nt, Human
cgggcacugguucugcccuuuuc

SEQ ID NO: 1374945 - RNA, 24 nt, Human
cuaaagcuacagccaacucuccua

SEQ ID NO: 1374946 - RNA, 23 nt, Human
cuacaaugagaguccacuuuucc

SEQ ID NO: 1374947 - RNA, 22 nt, Human
cucacacucccgaaagccuuug

SEQ ID NO: 1374948 - RNA, 18 nt, Human
cucacacucuuccuagca

SEQ ID NO: 1374949 - RNA, 20 nt, Human
cucucacucagccacccuuc

SEQ ID NO: 1374950 - RNA, 21 nt, Human
cucuggcuggagcugcccuuc

SEQ ID NO: 1374951 - RNA, 23 nt, Human
cugacccuuugcuugaugccuaa

SEQ ID NO: 1374952 - RNA, 22 nt, Human
cugaggcugaaacaugggccug

SEQ ID NO: 1374953 - RNA, 23 nt, Human
cugaggcugaaacaugggccugc

SEQ ID NO: 1374954 - RNA, 19 nt, Human
cugcaguccuucaaugucu

SEQ ID NO: 1374955 - RNA, 23 nt, Human
cugccuucucugaaguuugcucc

SEQ ID NO: 1374956 - RNA, 21 nt, Human
cuggagcugcccuuccugggu

SEQ ID NO: 1374957 - RNA, 22 nt, Human
cuggugacgggacagaagagaa

SEQ ID NO: 1374958 - RNA, 23 nt, Human
cuuugcuccguugcucugugauc

SEQ ID NO: 1374959 - RNA, 19 nt, Human
gaacgacucaguggcacaa

SEQ ID NO: 1374960 - RNA, 20 nt, Human
gaacucggaugggcaggaug

SEQ ID NO: 1374961 - RNA, 20 nt, Human
gaacuuggaaccaggagaug

SEQ ID NO: 1374962 - RNA, 20 nt, Human
gagcccgaacuuggaaccag

SEQ ID NO: 1374963 - RNA, 24 nt, Human
gagcgagcuucuuuucagcaggag

SEQ ID NO: 1374964 - RNA, 21 nt, Human
gaggcauucugggggaaagac

SEQ ID NO: 1374965 - RNA, 23 nt, Human
gagggggaauucaucaauggccu

SEQ ID NO: 1374966 - RNA, 23 nt, Human
gaucauauuucuacuuauccugg

SEQ ID NO: 1374967 - RNA, 22 nt, Human
gcaaggcaauguaucuuccucu

SEQ ID NO: 1374968 - RNA, 23 nt, Human
gcacccugcaccuauaucugcua

SEQ ID NO: 1374969 - RNA, 29 nt, Human
gcacguacacacacacgugcacaaauaca

SEQ ID NO: 1374970 - RNA, 21 nt, Human
gcagacaucuggagcgagcuu

SEQ ID NO: 1374971 - RNA, 22 nt, Human
gcagccucacacucccgaaagc

SEQ ID NO: 1374972 - RNA, 18 nt, Human
gcauagcuucccccagaa

SEQ ID NO: 1374973 - RNA, 21 nt, Human
gccaaauuggcuuccagaaau

SEQ ID NO: 1374974 - RNA, 21 nt, Human
gccaaccucaaguccugccac

SEQ ID NO: 1374975 - RNA, 22 nt, Human
gccagggguguggaagcaauag

SEQ ID NO: 1374976 - RNA, 22 nt, Human
gcccggugcacccauacauuuc

SEQ ID NO: 1374977 - RNA, 19 nt, Human
gcgaaacacagaagcaaaa

SEQ ID NO: 1374978 - RNA, 18 nt, Human
gcuacacauaccaugcug

SEQ ID NO: 1374979 - RNA, 20 nt, Human
gcuuggagaaauugggguga

SEQ ID NO: 1374980 - RNA, 20 nt, Human
ggaaagaagaggcagcccac

SEQ ID NO: 1374981 - RNA, 18 nt, Human
ggacacaggucuggcccu

SEQ ID NO: 1374982 - RNA, 21 nt, Human
ggacagaaccaccaaggggcu

SEQ ID NO: 1374983 - RNA, 23 nt, Human
ggagcagggucacagagcucaag

SEQ ID NO: 1374984 - RNA, 20 nt, Human
ggaggacaugggcaggacac

SEQ ID NO: 1374985 - RNA, 21 nt, Human
ggcacaaaggaaagagaagaa

SEQ ID NO: 1374986 - RNA, 25 nt, Human
ggcgaaacacagaagcaaaaccccu

SEQ ID NO: 1374987 - RNA, 21 nt, Human
gggaagacacuggggagggcu

SEQ ID NO: 1374988 - RNA, 21 nt, Human
ggggcucugagaaagcuaccu

SEQ ID NO: 1374989 - RNA, 21 nt, Human
ggugacgggacagaagagaaa

SEQ ID NO: 1374990 - RNA, 19 nt, Human
uaaaccaaauaacacagug

SEQ ID NO: 1374991 - RNA, 19 nt, Human
uaaccuccuaccagcacca

SEQ ID NO: 1374992 - RNA, 19 nt, Human
uaagagauucugggcuggc

SEQ ID NO: 1374993 - RNA, 18 nt, Human
uaauuucaaagacaaacc

SEQ ID NO: 1374994 - RNA, 19 nt, Human
uacacaggaacacacacac

SEQ ID NO: 1374995 - RNA, 22 nt, Human
uaccaugcuggaagugcacauc

SEQ ID NO: 1374996 - RNA, 33 nt, Human
uacuuacacaggaacacacacacacacgcagug

SEQ ID NO: 1374997 - RNA, 19 nt, Human
uagaacagaaagggugggu

SEQ ID NO: 1374998 - RNA, 25 nt, Human
ucaacaaugauagcauauuccuaag

SEQ ID NO: 1374999 - RNA, 21 nt, Human
ucacacauaucuagccagggc

SEQ ID NO: 1375000 - RNA, 23 nt, Human
ucacacucccgaaagccuuugcc

SEQ ID NO: 1375001 - RNA, 21 nt, Human
ucagaacucggaugggcagga

SEQ ID NO: 1375002 - RNA, 22 nt, Human
ucagccacccuucccucggccc

SEQ ID NO: 1375003 - RNA, 23 nt, Human
uccaccauagaacagaaagggug

SEQ ID NO: 1375004 - RNA, 21 nt, Human
ucccaucccuucaccuggaag

SEQ ID NO: 1375005 - RNA, 24 nt, Human
uccugauuaaaaccuuugaguccu

SEQ ID NO: 1375006 - RNA, 22 nt, Human
uccuucuccuaaggaagaacaa

SEQ ID NO: 1375007 - RNA, 21 nt, Human
ucgguaugaaaccaggcuggu

SEQ ID NO: 1375008 - RNA, 24 nt, Human
ucuaagccugagacuucagaagac

SEQ ID NO: 1375009 - RNA, 18 nt, Human
ucuaaggcagaguggaag

SEQ ID NO: 1375010 - RNA, 19 nt, Human
ugacaggagcagggucaca

SEQ ID NO: 1375011 - RNA, 21 nt, Human
ugacaggcacccugcaccuau

SEQ ID NO: 1375012 - RNA, 23 nt, Human
ugacgggacagaagagaaaagga

SEQ ID NO: 1375013 - RNA, 19 nt, Human
ugagcuuuggcgaaacaca

SEQ ID NO: 1375014 - RNA, 20 nt, Human
ugaggagggccaaccucaag

SEQ ID NO: 1375015 - RNA, 20 nt, Human
ugaguaaacagaaacgucca

SEQ ID NO: 1375016 - RNA, 21 nt, Human
ugcacccagcaggggcagaug

SEQ ID NO: 1375017 - RNA, 23 nt, Human
ugcgcguagugucagaccagcug

SEQ ID NO: 1375018 - RNA, 21 nt, Human
ugcugcucuccuucaaccagc

SEQ ID NO: 1375019 - RNA, 23 nt, Human
uggaaccaggagaugacaguuuc

SEQ ID NO: 1375020 - RNA, 21 nt, Human
uggaagcaauagccugcaucc

SEQ ID NO: 1375021 - RNA, 21 nt, Human
uggaagucagcucuccuggcu

SEQ ID NO: 1375022 - RNA, 24 nt, Human
uggcugacccuuugcuugaugccu

SEQ ID NO: 1375023 - RNA, 18 nt, Human
ugggaagacacuggggag

SEQ ID NO: 1375024 - RNA, 22 nt, Human
ugggcaggacacaggucuggcc

SEQ ID NO: 1375025 - RNA, 23 nt, Human
ugggcugaggcugaaacaugggc

SEQ ID NO: 1375026 - RNA, 18 nt, Human
uggggccauauggguggg

SEQ ID NO: 1375027 - RNA, 24 nt, Human
uguccucuggccagggaacgacuc

SEQ ID NO: 1375028 - RNA, 23 nt, Human
ugugcaaaccccaaaacaggauc

SEQ ID NO: 1375029 - RNA, 19 nt, Human
uucauuuauugaaaagaaa

SEQ ID NO: 1375030 - RNA, 19 nt, Human
uuccccuaauggccucaga

SEQ ID NO: 1375031 - RNA, 19 nt, Human
uuccuuuuccccuaauggc

SEQ ID NO: 1375032 - RNA, 23 nt, Human
uuggaacagaagagacagaaaaa

SEQ ID NO: 1375033 - RNA, 22 nt, Human
uuggagaaauuggggugacagg

SEQ ID NO: 1375034 - RNA, 20 nt, Human
uugguaacuucuaagccuga

SEQ ID NO: 1375035 - RNA, 21 nt, Human
uuuaggaggaggugcacugcc

SEQ ID NO: 1375036 - RNA, 18 nt, Human
uuuugcugcucuccuuca

SEQ ID NO: 1375037 - RNA, 20 nt, Human
aucccggauccgcgcggccc

SEQ ID NO: 1375038 - RNA, 23 nt, Human
cagaucccggauccgcgcggccc

SEQ ID NO: 1375039 - RNA, 21 nt, Human
ccccagcgcagaucccggauc

SEQ ID NO: 1375040 - RNA, 18 nt, Human
ccccccagcgcagauccc

SEQ ID NO: 1375041 - RNA, 21 nt, Human
ccccgcacgcggggacccccc

SEQ ID NO: 1375042 - RNA, 20 nt, Human
cccggccuccuccgcagggc

SEQ ID NO: 1375043 - RNA, 25 nt, Human
ccgcccgggauaccgacuggcggcc

SEQ ID NO: 1375044 - RNA, 18 nt, Human
ccggcggugguaccgcuu

SEQ ID NO: 1375045 - RNA, 30 nt, Human
cgcagaucccggauccgcgcggcccuucuc

SEQ ID NO: 1375046 - RNA, 20 nt, Human
cgccugguuauggcagggcc

SEQ ID NO: 1375047 - RNA, 18 nt, Human
cggccgcccccgccgccc

SEQ ID NO: 1375048 - RNA, 22 nt, Human
cuccgcagggcugggcgccugg

SEQ ID NO: 1375049 - RNA, 21 nt, Human
cugccgcaggaaguccuccuc

SEQ ID NO: 1375050 - RNA, 21 nt, Human
cugggagccccggccuccucc

SEQ ID NO: 1375051 - RNA, 24 nt, Human
gaccugccgcaggaaguccuccuc

SEQ ID NO: 1375052 - RNA, 19 nt, Human
gccgccgcuucuccacugc

SEQ ID NO: 1375053 - RNA, 21 nt, Human
gccgccgcuucuccacugccg

SEQ ID NO: 1375054 - RNA, 19 nt, Human
gccgcuucuccacugccgc

SEQ ID NO: 1375055 - RNA, 21 nt, Human
gccggcggugguaccgcuugc

SEQ ID NO: 1375056 - RNA, 23 nt, Human
gccugguuauggcagggccucac

SEQ ID NO: 1375057 - RNA, 22 nt, Human
gcguccgcuuccugggagcccc

SEQ ID NO: 1375058 - RNA, 21 nt, Human
ggcucccgcggggguggaggg

SEQ ID NO: 1375059 - RNA, 20 nt, Human
gggcaggggcucccgcgggg

SEQ ID NO: 1375060 - RNA, 19 nt, Human
ggggaccgggcguccgcuu

SEQ ID NO: 1375061 - RNA, 21 nt, Human
ucccgcggggguggaggggcg

SEQ ID NO: 1375062 - RNA, 19 nt, Human
uccgcgcgccccgcacgcg

SEQ ID NO: 1375063 - RNA, 20 nt, Human
uccgcgcgccccgcacgcgg

SEQ ID NO: 1375064 - RNA, 19 nt, Human
uggaggggcggccgcggcg

SEQ ID NO: 1375065 - RNA, 25 nt, Human
uggggcaggggcucccgcgggggug

SEQ ID NO: 1375066 - RNA, 19 nt, Human
aaacgcagauguggcuucu

SEQ ID NO: 1375067 - RNA, 21 nt, Human
aaaggacaaacgcagaugugg

SEQ ID NO: 1375068 - RNA, 20 nt, Human
acacaaaauagauuucagcc

SEQ ID NO: 1375069 - RNA, 18 nt, Human
agccggcagaacuggagg

SEQ ID NO: 1375070 - RNA, 21 nt, Human
caaaauagauuucagccacgu

SEQ ID NO: 1375071 - RNA, 22 nt, Human
caaaggacaaacgcagaugugg

SEQ ID NO: 1375072 - RNA, 20 nt, Human
ccccgcgcugcaggcccccc

SEQ ID NO: 1375073 - RNA, 22 nt, Human
ccgggccccgcgcugcaggccc

SEQ ID NO: 1375074 - RNA, 21 nt, Human
ccggggcuuccaugaggcgcc

SEQ ID NO: 1375075 - RNA, 19 nt, Human
cgauuucaugacuuuccuu

SEQ ID NO: 1375076 - RNA, 20 nt, Human
cggaaggagaggcggccccg

SEQ ID NO: 1375077 - RNA, 23 nt, Human
cugcaggccccccuccgccgccu

SEQ ID NO: 1375078 - RNA, 24 nt, Human
ggacaaacgcagauguggcuucuc

SEQ ID NO: 1375079 - RNA, 18 nt, Human
uaagaaauccguagggau

SEQ ID NO: 1375080 - RNA, 20 nt, Human
ucucuuugggcaggccuggg

SEQ ID NO: 1375081 - RNA, 24 nt, Human
ucuuugggcaggccugggccagga

SEQ ID NO: 1375082 - RNA, 23 nt, Human
uguggcuucucuuugggcaggcc

SEQ ID NO: 1375083 - RNA, 21 nt, Human
uuguaucaccuuuuauuacac

SEQ ID NO: 1375084 - RNA, 22 nt, Human
aaaaucuuugaccuugcucaua

SEQ ID NO: 1375085 - RNA, 19 nt, Human
aaaccaccagugaaucuag

SEQ ID NO: 1375086 - RNA, 21 nt, Human
aaaugaccgauguggcauaaa

SEQ ID NO: 1375087 - RNA, 22 nt, Human
aacucuaaaaugccuugccagc

SEQ ID NO: 1375088 - RNA, 23 nt, Human
aagauggacccaaucauugcaga

SEQ ID NO: 1375089 - RNA, 23 nt, Human
aagcagggccaagggcugugauc

SEQ ID NO: 1375090 - RNA, 24 nt, Human
aaguaggaggcaguuucucccaag

SEQ ID NO: 1375091 - RNA, 18 nt, Human
aaguaugaagcagggcca

SEQ ID NO: 1375092 - RNA, 21 nt, Human
acagagcccugccucaggcug

SEQ ID NO: 1375093 - RNA, 25 nt, Human
acagagcccugccucaggcuguugg

SEQ ID NO: 1375094 - RNA, 23 nt, Human
acccaguccacaucccuccccuu

SEQ ID NO: 1375095 - RNA, 24 nt, Human
accugacggcuaagccagggauga

SEQ ID NO: 1375096 - RNA, 23 nt, Human
acuuucaggagccucugguuuuu

SEQ ID NO: 1375097 - RNA, 24 nt, Human
agaagaagacagaugugaggugca

SEQ ID NO: 1375098 - RNA, 23 nt, Human
agaaugagaggagauggucugga

SEQ ID NO: 1375099 - RNA, 18 nt, Human
agagcagaccagguuuuu

SEQ ID NO: 1375100 - RNA, 18 nt, Human
agaggugggccacccucg

SEQ ID NO: 1375101 - RNA, 22 nt, Human
agauauguggccugcuuacccu

SEQ ID NO: 1375102 - RNA, 21 nt, Human
agcaagauggacccaaucauu

SEQ ID NO: 1375103 - RNA, 18 nt, Human
agcaggcagcuggggaug

SEQ ID NO: 1375104 - RNA, 22 nt, Human
agcaggcagcuggggauggucc

SEQ ID NO: 1375105 - RNA, 19 nt, Human
agcucccucccuuagaagc

SEQ ID NO: 1375106 - RNA, 19 nt, Human
aggaauaccagagaugacc

SEQ ID NO: 1375107 - RNA, 22 nt, Human
aggagagacaccucugcccagc

SEQ ID NO: 1375108 - RNA, 22 nt, Human
aggaggagcccugggggcugcc

SEQ ID NO: 1375109 - RNA, 21 nt, Human
aggcagagucaagacaaucau

SEQ ID NO: 1375110 - RNA, 19 nt, Human
aggcaggcuggugggcuuc

SEQ ID NO: 1375111 - RNA, 21 nt, Human
aggcaggcuggugggcuucac

SEQ ID NO: 1375112 - RNA, 22 nt, Human
aggugcaggucauaagccuggg

SEQ ID NO: 1375113 - RNA, 18 nt, Human
aguaacugucuacuccau

SEQ ID NO: 1375114 - RNA, 24 nt, Human
aguggcggagaagguucugucuca

SEQ ID NO: 1375115 - RNA, 19 nt, Human
auaaaauauacagugcuac

SEQ ID NO: 1375116 - RNA, 21 nt, Human
aucccaccacacuagagagca

SEQ ID NO: 1375117 - RNA, 22 nt, Human
aucccuccccuuccucuuccua

SEQ ID NO: 1375118 - RNA, 19 nt, Human
augggcgcccccuaguggg

SEQ ID NO: 1375119 - RNA, 18 nt, Human
augggggagguaccagga

SEQ ID NO: 1375120 - RNA, 22 nt, Human
auuugggcaccagguuucagcc

SEQ ID NO: 1375121 - RNA, 24 nt, Human
caaggcagagucaagacaaucauu

SEQ ID NO: 1375122 - RNA, 26 nt, Human
caagggaaugucacagaugggggagg

SEQ ID NO: 1375123 - RNA, 27 nt, Human
caccaguaagaacuaaaucccugggcc

SEQ ID NO: 1375124 - RNA, 20 nt, Human
caccucugcccagcccuacc

SEQ ID NO: 1375125 - RNA, 18 nt, Human
caccugguguaaacgacu

SEQ ID NO: 1375126 - RNA, 23 nt, Human
cacugagcguuuaguagcucugg

SEQ ID NO: 1375127 - RNA, 24 nt, Human
cacuggaggaggagcccugggggc

SEQ ID NO: 1375128 - RNA, 23 nt, Human
cagaauguccaaggugcuuccuc

SEQ ID NO: 1375129 - RNA, 19 nt, Human
cagaauugaauccaggcug

SEQ ID NO: 1375130 - RNA, 21 nt, Human
cagaauugaauccaggcugac

SEQ ID NO: 1375131 - RNA, 19 nt, Human
cagagcccugccucaggcu

SEQ ID NO: 1375132 - RNA, 21 nt, Human
cagcaaugggggacuguugca

SEQ ID NO: 1375133 - RNA, 18 nt, Human
cauaagcagaugccugcc

SEQ ID NO: 1375134 - RNA, 22 nt, Human
caucugaggacggcuauugcuc

SEQ ID NO: 1375135 - RNA, 22 nt, Human
ccacugccggccugggccacag

SEQ ID NO: 1375136 - RNA, 21 nt, Human
ccacuggaugaucccuuuuau

SEQ ID NO: 1375137 - RNA, 23 nt, Human
ccauaagauggcaauggcucaug

SEQ ID NO: 1375138 - RNA, 22 nt, Human
cccauccccuucacuccgggaa

SEQ ID NO: 1375139 - RNA, 21 nt, Human
ccccauccuccucuccaccug

SEQ ID NO: 1375140 - RNA, 24 nt, Human
ccccuagugggguuaccaucgcuc

SEQ ID NO: 1375141 - RNA, 22 nt, Human
ccccuugccguucauggagacu

SEQ ID NO: 1375142 - RNA, 18 nt, Human
cccuccccuuccucuucc

SEQ ID NO: 1375143 - RNA, 19 nt, Human
cccugccucaggcuguugg

SEQ ID NO: 1375144 - RNA, 19 nt, Human
cccuuccucuuccuagauc

SEQ ID NO: 1375145 - RNA, 22 nt, Human
ccggucugccuagagccgggag

SEQ ID NO: 1375146 - RNA, 18 nt, Human
ccuccccuuccucuuccu

SEQ ID NO: 1375147 - RNA, 19 nt, Human
ccugccaguagagaaaugc

SEQ ID NO: 1375148 - RNA, 19 nt, Human
ccuggauaauaaaaauucc

SEQ ID NO: 1375149 - RNA, 23 nt, Human
ccuuccaccugcuuuucuccuca

SEQ ID NO: 1375150 - RNA, 21 nt, Human
ccuuggaagucauguaggcug

SEQ ID NO: 1375151 - RNA, 21 nt, Human
ccuuuagggcugaaaccuggg

SEQ ID NO: 1375152 - RNA, 19 nt, Human
cuagaaucuuccgccagca

SEQ ID NO: 1375153 - RNA, 21 nt, Human
cuagcagccuuuaagcucccu

SEQ ID NO: 1375154 - RNA, 21 nt, Human
cucaaggagagacaccucugc

SEQ ID NO: 1375155 - RNA, 19 nt, Human
cucagauuaaggcgaaaca

SEQ ID NO: 1375156 - RNA, 19 nt, Human
cuccacacucgcaaacuga

SEQ ID NO: 1375157 - RNA, 22 nt, Human
cuccacacucgcaaacugacug

SEQ ID NO: 1375158 - RNA, 24 nt, Human
cuccucagguucugcugugucucu

SEQ ID NO: 1375159 - RNA, 18 nt, Human
cucugugaggugcucuga

SEQ ID NO: 1375160 - RNA, 20 nt, Human
cugacucgguuucucugggg

SEQ ID NO: 1375161 - RNA, 20 nt, Human
cugagcuggcaucaaacacc

SEQ ID NO: 1375162 - RNA, 21 nt, Human
cugccuugaagaaacacucca

SEQ ID NO: 1375163 - RNA, 19 nt, Human
cugugcaugaucauggggg

SEQ ID NO: 1375164 - RNA, 18 nt, Human
cuuccucccagcaaaggg

SEQ ID NO: 1375165 - RNA, 20 nt, Human
cuucuuaggaugaguccugg

SEQ ID NO: 1375166 - RNA, 23 nt, Human
gaaggcagagccugcuguccauc

SEQ ID NO: 1375167 - RNA, 19 nt, Human
gaagugggggaagccuggg

SEQ ID NO: 1375168 - RNA, 18 nt, Human
gaaguucaucccaccaca

SEQ ID NO: 1375169 - RNA, 22 nt, Human
gaccuccaggguagcuacccag

SEQ ID NO: 1375170 - RNA, 18 nt, Human
gagaggccaacauucuuc

SEQ ID NO: 1375171 - RNA, 19 nt, Human
gagcucacuggaggaggag

SEQ ID NO: 1375172 - RNA, 22 nt, Human
gagcucacuggaggaggagccc

SEQ ID NO: 1375173 - RNA, 23 nt, Human
gaggagcccugggggcugcccag

SEQ ID NO: 1375174 - RNA, 18 nt, Human
gcaacuggugacuggaug

SEQ ID NO: 1375175 - RNA, 20 nt, Human
gccugcuuacccuuaagggg

SEQ ID NO: 1375176 - RNA, 18 nt, Human
gccugggccacagagccc

SEQ ID NO: 1375177 - RNA, 22 nt, Human
gcggagaagguucugucucaga

SEQ ID NO: 1375178 - RNA, 25 nt, Human
gcuacagccaugguaucaauccacc

SEQ ID NO: 1375179 - RNA, 20 nt, Human
gcuagagugaggaauaccag

SEQ ID NO: 1375180 - RNA, 19 nt, Human
gcuccauaacuccaggaac

SEQ ID NO: 1375181 - RNA, 21 nt, Human
gcucuacccccauccccuuca

SEQ ID NO: 1375182 - RNA, 18 nt, Human
ggacgccaaucuaaaaac

SEQ ID NO: 1375183 - RNA, 24 nt, Human
ggagcaggcagcuggggauggucc

SEQ ID NO: 1375184 - RNA, 19 nt, Human
ggaggaacagaggacucug

SEQ ID NO: 1375185 - RNA, 19 nt, Human
ggauuccaaagggaaggcu

SEQ ID NO: 1375186 - RNA, 19 nt, Human
ggcacuccugagacagucu

SEQ ID NO: 1375187 - RNA, 25 nt, Human
ggcagagcugagaaaauuugagggg

SEQ ID NO: 1375188 - RNA, 19 nt, Human
ggccaugaagacagaagga

SEQ ID NO: 1375189 - RNA, 21 nt, Human
gggaagugggggaagccuggg

SEQ ID NO: 1375190 - RNA, 22 nt, Human
gggaagugggggaagccugggu

SEQ ID NO: 1375191 - RNA, 19 nt, Human
gggcagggcuuaucuggcc

SEQ ID NO: 1375192 - RNA, 18 nt, Human
ggggaagugggggaagcc

SEQ ID NO: 1375193 - RNA, 18 nt, Human
ggggcaggugucagaaaa

SEQ ID NO: 1375194 - RNA, 20 nt, Human
gguccccauguggcucccag

SEQ ID NO: 1375195 - RNA, 18 nt, Human
ggugcaggucauaagccu

SEQ ID NO: 1375196 - RNA, 25 nt, Human
ggugguuccccuugccguucaugga

SEQ ID NO: 1375197 - RNA, 19 nt, Human
guccccauccuccucucca

SEQ ID NO: 1375198 - RNA, 20 nt, Human
gucgucuuucaucuggggga

SEQ ID NO: 1375199 - RNA, 23 nt, Human
gugcaugaucaugggggagguac

SEQ ID NO: 1375200 - RNA, 21 nt, Human
guuucuagcagccuuuaagcu

SEQ ID NO: 1375201 - RNA, 21 nt, Human
uaaaaugucacaauuuguguc

SEQ ID NO: 1375202 - RNA, 19 nt, Human
uaaacgacuuucaggagcc

SEQ ID NO: 1375203 - RNA, 23 nt, Human
uaacaguagcuuuaaugaauuaa

SEQ ID NO: 1375204 - RNA, 24 nt, Human
uaagaacuaaaucccugggccucc

SEQ ID NO: 1375205 - RNA, 20 nt, Human
uaagcuccaaaguaugaagg

SEQ ID NO: 1375206 - RNA, 18 nt, Human
uaagggggugcacuggga

SEQ ID NO: 1375207 - RNA, 24 nt, Human
uacaacuccacuggaugaucccuu

SEQ ID NO: 1375208 - RNA, 23 nt, Human
uacagccaugguaucaauccacc

SEQ ID NO: 1375209 - RNA, 22 nt, Human
uacagugcuacaacugcagaau

SEQ ID NO: 1375210 - RNA, 20 nt, Human
uagaaaaacauaaagaugaa

SEQ ID NO: 1375211 - RNA, 19 nt, Human
uagccagcagcucccuaga

SEQ ID NO: 1375212 - RNA, 20 nt, Human
uagcucuacccccauccccu

SEQ ID NO: 1375213 - RNA, 21 nt, Human
uaggagaugcuccaugcucac

SEQ ID NO: 1375214 - RNA, 21 nt, Human
uauccaacagagaacagggag

SEQ ID NO: 1375215 - RNA, 24 nt, Human
uauuauguaaaccuuaacauaaga

SEQ ID NO: 1375216 - RNA, 23 nt, Human
ucaaacaccuacuucaaaaugac

SEQ ID NO: 1375217 - RNA, 19 nt, Human
ucaaccagguuguaacaaa

SEQ ID NO: 1375218 - RNA, 20 nt, Human
ucagaaaaggugcaggucau

SEQ ID NO: 1375219 - RNA, 20 nt, Human
ucagccacaauucugcuagg

SEQ ID NO: 1375220 - RNA, 23 nt, Human
ucaguccauuagggcucucuauu

SEQ ID NO: 1375221 - RNA, 20 nt, Human
ucauuuuaagccacugaguu

SEQ ID NO: 1375222 - RNA, 20 nt, Human
uccaaaguaugaagcagggc

SEQ ID NO: 1375223 - RNA, 22 nt, Human
uccaaccuggauugugaucacu

SEQ ID NO: 1375224 - RNA, 18 nt, Human
uccaaggcccuugagagg

SEQ ID NO: 1375225 - RNA, 19 nt, Human
ucccaggaauccaaggccc

SEQ ID NO: 1375226 - RNA, 21 nt, Human
uccccauguggcucccaggaa

SEQ ID NO: 1375227 - RNA, 19 nt, Human
ucccuccccuuccucuucc

SEQ ID NO: 1375228 - RNA, 24 nt, Human
ucccugaaagugucuuccuucacc

SEQ ID NO: 1375229 - RNA, 18 nt, Human
uccucagguucugcugug

SEQ ID NO: 1375230 - RNA, 18 nt, Human
ucuaaaaacagcaaauau

SEQ ID NO: 1375231 - RNA, 19 nt, Human
ucuaaaaugccuugccagc

SEQ ID NO: 1375232 - RNA, 21 nt, Human
ucuaugggauuccaaagggaa

SEQ ID NO: 1375233 - RNA, 21 nt, Human
ucucucaaggagagacaccuc

SEQ ID NO: 1375234 - RNA, 18 nt, Human
ucucugaguaggggaggg

SEQ ID NO: 1375235 - RNA, 19 nt, Human
ucucugaguaggggagggg

SEQ ID NO: 1375236 - RNA, 21 nt, Human
ucuuccucccagcaaagggug

SEQ ID NO: 1375237 - RNA, 21 nt, Human
ugaaaccugggcaugaggcug

SEQ ID NO: 1375238 - RNA, 21 nt, Human
ugaacuuucuuggcacagaaa

SEQ ID NO: 1375239 - RNA, 18 nt, Human
ugaagcagggccaagggc

SEQ ID NO: 1375240 - RNA, 18 nt, Human
ugaagcagggccaagggc

SEQ ID NO: 1375241 - RNA, 21 nt, Human
ugaccuccaggguagcuaccc

SEQ ID NO: 1375242 - RNA, 21 nt, Human
ugacugcaggguccgcaccuc

SEQ ID NO: 1375243 - RNA, 20 nt, Human
ugagaaugagaggagauggu

SEQ ID NO: 1375244 - RNA, 18 nt, Human
ugagugaucucagccuuc

SEQ ID NO: 1375245 - RNA, 18 nt, Human
ugaguugaagcaguucca

SEQ ID NO: 1375246 - RNA, 21 nt, Human
ugaucagacccaguccacauc

SEQ ID NO: 1375247 - RNA, 21 nt, Human
ugaugugagcucacuggagga

SEQ ID NO: 1375248 - RNA, 22 nt, Human
ugccaaggcagagucaagacaa

SEQ ID NO: 1375249 - RNA, 21 nt, Human
ugccguucauggagaccagcg

SEQ ID NO: 1375250 - RNA, 18 nt, Human
ugcuacaacugcagaauu

SEQ ID NO: 1375251 - RNA, 19 nt, Human
ugcuuugggggcagguguc

SEQ ID NO: 1375252 - RNA, 19 nt, Human
uggaauuucagauaaacca

SEQ ID NO: 1375253 - RNA, 18 nt, Human
uggaggaggagcccuggg

SEQ ID NO: 1375254 - RNA, 23 nt, Human
uggaggaggagcccugggggcug

SEQ ID NO: 1375255 - RNA, 20 nt, Human
uggaugugaagauggcuacc

SEQ ID NO: 1375256 - RNA, 22 nt, Human
uggcggagaagguucugucuca

SEQ ID NO: 1375257 - RNA, 22 nt, Human
uggcuacacccuuacuucuauu

SEQ ID NO: 1375258 - RNA, 18 nt, Human
ugggaggaacagaggacu

SEQ ID NO: 1375259 - RNA, 21 nt, Human
ugggcccaagggaaugucaca

SEQ ID NO: 1375260 - RNA, 27 nt, Human
ugggcgcccccuagugggggggacacc

SEQ ID NO: 1375261 - RNA, 21 nt, Human
uggggaugguccccauguggc

SEQ ID NO: 1375262 - RNA, 22 nt, Human
ugggguuaccaucgcuccucca

SEQ ID NO: 1375263 - RNA, 24 nt, Human
ugguucccuuguuuacaacuccac

SEQ ID NO: 1375264 - RNA, 25 nt, Human
uguggcucccaggaacaugcucuca

SEQ ID NO: 1375265 - RNA, 22 nt, Human
uuaaugcacaauauuuugaaaa

SEQ ID NO: 1375266 - RNA, 18 nt, Human
uucacuucucuauagaaa

SEQ ID NO: 1375267 - RNA, 21 nt, Human
uucauggagaccagcggcaga

SEQ ID NO: 1375268 - RNA, 20 nt, Human
uuccaaagggaaggcuucgg

SEQ ID NO: 1375269 - RNA, 21 nt, Human
uuccaaagggaaggcuucggg

SEQ ID NO: 1375270 - RNA, 24 nt, Human
uuccucucugaguaggggaggggg

SEQ ID NO: 1375271 - RNA, 24 nt, Human
uuccugccucaguccauuagggcu

SEQ ID NO: 1375272 - RNA, 20 nt, Human
uugcaagggcauccucuguc

SEQ ID NO: 1375273 - RNA, 22 nt, Human
uuucaggagccucugguuuuua

SEQ ID NO: 1375274 - RNA, 20 nt, Human
uuucuccucagguucugcug

SEQ ID NO: 1375275 - RNA, 18 nt, Human
uuugaggggaaguggggg

SEQ ID NO: 1375276 - RNA, 18 nt, Human
uuuguugccugaaguuca

SEQ ID NO: 1375277 - RNA, 31 nt, Human
aaacaacaauaaauauguaucaucuugcacc

SEQ ID NO: 1375278 - RNA, 24 nt, Human
aaagugcugggauuauagguguga

SEQ ID NO: 1375279 - RNA, 22 nt, Human
aaaucaacauuagcuuugcuag

SEQ ID NO: 1375280 - RNA, 21 nt, Human
aagccccccaggagcucuagg

SEQ ID NO: 1375281 - RNA, 18 nt, Human
aaggacaggcccaggggc

SEQ ID NO: 1375282 - RNA, 18 nt, Human
aagugcugggauuauagg

SEQ ID NO: 1375283 - RNA, 26 nt, Human
aagugcugggauuauaggugugagcc

SEQ ID NO: 1375284 - RNA, 23 nt, Human
aauaaucugcauuucuccuucag

SEQ ID NO: 1375285 - RNA, 23 nt, Human
acacaacccuuccuggugccacc

SEQ ID NO: 1375286 - RNA, 21 nt, Human
acaggcaccugccaccaugcc

SEQ ID NO: 1375287 - RNA, 20 nt, Human
accacacuuuagcucccagg

SEQ ID NO: 1375288 - RNA, 22 nt, Human
accagugccucccucugacagg

SEQ ID NO: 1375289 - RNA, 18 nt, Human
acccuaguguuuccaagc

SEQ ID NO: 1375290 - RNA, 25 nt, Human
accguggggccucuuccccagcccu

SEQ ID NO: 1375291 - RNA, 23 nt, Human
accucggccucccaaagugcugg

SEQ ID NO: 1375292 - RNA, 20 nt, Human
acggcacagagcaggcaggc

SEQ ID NO: 1375293 - RNA, 18 nt, Human
acucugucacccaggcug

SEQ ID NO: 1375294 - RNA, 25 nt, Human
acucugucacccaggcuggagugca

SEQ ID NO: 1375295 - RNA, 19 nt, Human
acuuguucaucaugcuuca

SEQ ID NO: 1375296 - RNA, 27 nt, Human
agaaggacaggcccaggggcauacaga

SEQ ID NO: 1375297 - RNA, 24 nt, Human
agcaccuacgacagagccugcaua

SEQ ID NO: 1375298 - RNA, 18 nt, Human
agcaugaauaccugcaga

SEQ ID NO: 1375299 - RNA, 19 nt, Human
agccggggcugguggggcc

SEQ ID NO: 1375300 - RNA, 23 nt, Human
agccuuaggccucugggcagcca

SEQ ID NO: 1375301 - RNA, 18 nt, Human
agcucccagcuuggauga

SEQ ID NO: 1375302 - RNA, 19 nt, Human
aggaaaaggagaauaucca

SEQ ID NO: 1375303 - RNA, 22 nt, Human
aggagagauaggguuucgccau

SEQ ID NO: 1375304 - RNA, 23 nt, Human
aggaggaagggagcaggccagaa

SEQ ID NO: 1375305 - RNA, 22 nt, Human
aggcagaaggacaggcccaggg

SEQ ID NO: 1375306 - RNA, 25 nt, Human
aggcuggagugcaguagugcaaucu

SEQ ID NO: 1375307 - RNA, 21 nt, Human
agggagccaaggaggaaggga

SEQ ID NO: 1375308 - RNA, 22 nt, Human
aggguuucgccauguuggccag

SEQ ID NO: 1375309 - RNA, 24 nt, Human
aggugauccacucaccucggccuc

SEQ ID NO: 1375310 - RNA, 20 nt, Human
aggugugagccaccucgucc

SEQ ID NO: 1375311 - RNA, 21 nt, Human
agguuuggggacucagccugu

SEQ ID NO: 1375312 - RNA, 21 nt, Human
aguaguugggauuacaggcac

SEQ ID NO: 1375313 - RNA, 23 nt, Human
agugcaguagugcaaucuugguu

SEQ ID NO: 1375314 - RNA, 23 nt, Human
agugcaguagugcaaucuugguu

SEQ ID NO: 1375315 - RNA, 24 nt, Human
agugcaguagugcaaucuugguuu

SEQ ID NO: 1375316 - RNA, 20 nt, Human
agugguccuggacuaacuga

SEQ ID NO: 1375317 - RNA, 22 nt, Human
auagagccuguggagucagacu

SEQ ID NO: 1375318 - RNA, 18 nt, Human
auaggguuucgccauguu

SEQ ID NO: 1375319 - RNA, 23 nt, Human
auaggguuucgccauguuggcca

SEQ ID NO: 1375320 - RNA, 24 nt, Human
auaggguuucgccauguuggccag

SEQ ID NO: 1375321 - RNA, 20 nt, Human
aucugaaggcucaacugggg

SEQ ID NO: 1375322 - RNA, 19 nt, Human
augaauaccugcagacauc

SEQ ID NO: 1375323 - RNA, 22 nt, Human
augacuucucuccuccaauccu

SEQ ID NO: 1375324 - RNA, 19 nt, Human
auggagccuugugagccgg

SEQ ID NO: 1375325 - RNA, 24 nt, Human
caaagugcugggauuauaggugug

SEQ ID NO: 1375326 - RNA, 19 nt, Human
caacagggcaacccuauuc

SEQ ID NO: 1375327 - RNA, 24 nt, Human
caacuugaauccccccagcaccua

SEQ ID NO: 1375328 - RNA, 21 nt, Human
caagagacaaugcagaaguac

SEQ ID NO: 1375329 - RNA, 21 nt, Human
caagccccccaggagcucuag

SEQ ID NO: 1375330 - RNA, 23 nt, Human
cacacaacccuuccuggugccac

SEQ ID NO: 1375331 - RNA, 22 nt, Human
cacagacuguaggugcuccuga

SEQ ID NO: 1375332 - RNA, 20 nt, Human
cacaguuagcuccauggaaa

SEQ ID NO: 1375333 - RNA, 24 nt, Human
caccagcuuggggucuagcccacg

SEQ ID NO: 1375334 - RNA, 24 nt, Human
caccaugcccggcuaauuuuugua

SEQ ID NO: 1375335 - RNA, 19 nt, Human
cacccccaccagaucccac

SEQ ID NO: 1375336 - RNA, 23 nt, Human
cacccccaccagaucccacacca

SEQ ID NO: 1375337 - RNA, 23 nt, Human
cacggcacagagcaggcaggcuc

SEQ ID NO: 1375338 - RNA, 20 nt, Human
cacuagaaguucagcaacuu

SEQ ID NO: 1375339 - RNA, 22 nt, Human
cacucgcccuguccccccagcu

SEQ ID NO: 1375340 - RNA, 23 nt, Human
cacucugucacccaggcuggagu

SEQ ID NO: 1375341 - RNA, 24 nt, Human
cacucugucacccaggcuggagug

SEQ ID NO: 1375342 - RNA, 18 nt, Human
cagaaagggccuugccuu

SEQ ID NO: 1375343 - RNA, 24 nt, Human
cagaaagggccuugccuugcagca

SEQ ID NO: 1375344 - RNA, 22 nt, Human
cagaaggacaggcccaggggca

SEQ ID NO: 1375345 - RNA, 27 nt, Human
cagaccccaacaauggagccuugugag

SEQ ID NO: 1375346 - RNA, 18 nt, Human
cagaguuaggaaaaggag

SEQ ID NO: 1375347 - RNA, 18 nt, Human
cagauguucacagcucuc

SEQ ID NO: 1375348 - RNA, 25 nt, Human
cagcaggacaugcccgggaugcuug

SEQ ID NO: 1375349 - RNA, 28 nt, Human
cagcaggcuggccuccuuucccccuggg

SEQ ID NO: 1375350 - RNA, 20 nt, Human
cagccuccugaguaguuggg

SEQ ID NO: 1375351 - RNA, 19 nt, Human
cagccuccugguaauaauc

SEQ ID NO: 1375352 - RNA, 21 nt, Human
cagcucccucagcugaugccc

SEQ ID NO: 1375353 - RNA, 18 nt, Human
cagcuuggggucuagccc

SEQ ID NO: 1375354 - RNA, 22 nt, Human
caggagccagggagccaaggag

SEQ ID NO: 1375355 - RNA, 19 nt, Human
caggcagaaggacaggccc

SEQ ID NO: 1375356 - RNA, 25 nt, Human
cagucagacaaaauuccucucucag

SEQ ID NO: 1375357 - RNA, 22 nt, Human
cagugugcuggaggagccgcgg

SEQ ID NO: 1375358 - RNA, 19 nt, Human
cauggaacuuucuguagga

SEQ ID NO: 1375359 - RNA, 24 nt, Human
cauguuggccaggcuggucuugaa

SEQ ID NO: 1375360 - RNA, 22 nt, Human
cauuucugcuucuccuucuugu

SEQ ID NO: 1375361 - RNA, 20 nt, Human
cauuucuuuucuccugccug

SEQ ID NO: 1375362 - RNA, 21 nt, Human
ccaaagugcugggauuauagg

SEQ ID NO: 1375363 - RNA, 24 nt, Human
ccaaagugcugggauuauaggugu

SEQ ID NO: 1375364 - RNA, 22 nt, Human
ccaacccucaugguccccagau

SEQ ID NO: 1375365 - RNA, 25 nt, Human
ccaagccccccaggagccggguguc

SEQ ID NO: 1375366 - RNA, 19 nt, Human
ccacacuuuagcucccagc

SEQ ID NO: 1375367 - RNA, 22 nt, Human
ccaccagaucccacaccaaccc

SEQ ID NO: 1375368 - RNA, 22 nt, Human
ccaccuuaugcacagggaggca

SEQ ID NO: 1375369 - RNA, 21 nt, Human
ccacgguuaaacauugacuua

SEQ ID NO: 1375370 - RNA, 23 nt, Human
ccagaaccguggggccucuuccc

SEQ ID NO: 1375371 - RNA, 19 nt, Human
ccauguuggccaggcuggu

SEQ ID NO: 1375372 - RNA, 18 nt, Human
cccaacccugccuucagc

SEQ ID NO: 1375373 - RNA, 24 nt, Human
cccaaggacucccuguauccugcc

SEQ ID NO: 1375374 - RNA, 20 nt, Human
cccaauccuagccuacagcc

SEQ ID NO: 1375375 - RNA, 21 nt, Human
cccacacugcuuucuaggcca

SEQ ID NO: 1375376 - RNA, 18 nt, Human
cccagcccuugacacucc

SEQ ID NO: 1375377 - RNA, 22 nt, Human
cccagcccuugacacucccaac

SEQ ID NO: 1375378 - RNA, 24 nt, Human
ccccagauggacuuaggaugacuc

SEQ ID NO: 1375379 - RNA, 22 nt, Human
ccccagcaccuacgacagagcc

SEQ ID NO: 1375380 - RNA, 19 nt, Human
ccccaggagcucuaggacc

SEQ ID NO: 1375381 - RNA, 20 nt, Human
ccccaggagcucuaggaccc

SEQ ID NO: 1375382 - RNA, 21 nt, Human
ccccaggagcucuaggacccu

SEQ ID NO: 1375383 - RNA, 26 nt, Human
cccccagcaccuacgacagagccugc

SEQ ID NO: 1375384 - RNA, 18 nt, Human
ccccgccuucccucuguc

SEQ ID NO: 1375385 - RNA, 18 nt, Human
ccccgggggugugcuggg

SEQ ID NO: 1375386 - RNA, 20 nt, Human
ccccuguaauugcauguccc

SEQ ID NO: 1375387 - RNA, 19 nt, Human
cccuacccucacagcaggc

SEQ ID NO: 1375388 - RNA, 18 nt, Human
cccucugccucuggccuc

SEQ ID NO: 1375389 - RNA, 19 nt, Human
ccuagaccacccccaccag

SEQ ID NO: 1375390 - RNA, 19 nt, Human
ccucccagugguccuggac

SEQ ID NO: 1375391 - RNA, 22 nt, Human
ccucguccggcccaaacugaca

SEQ ID NO: 1375392 - RNA, 26 nt, Human
ccucugccuaccucccacucucccua

SEQ ID NO: 1375393 - RNA, 20 nt, Human
ccucugggcagccauggcuc

SEQ ID NO: 1375394 - RNA, 28 nt, Human
ccucugggcagccauggcuccagccacu

SEQ ID NO: 1375395 - RNA, 24 nt, Human
ccugaccucaggugauccacucac

SEQ ID NO: 1375396 - RNA, 18 nt, Human
ccugagaggcccccagag

SEQ ID NO: 1375397 - RNA, 23 nt, Human
ccugaguaguugggauuacaggc

SEQ ID NO: 1375398 - RNA, 24 nt, Human
ccugaguaguugggauuacaggca

SEQ ID NO: 1375399 - RNA, 23 nt, Human
ccugaguucaagcaauuuuccug

SEQ ID NO: 1375400 - RNA, 22 nt, Human
ccugcaugacuucucuccucca

SEQ ID NO: 1375401 - RNA, 18 nt, Human
ccuggccugucucuucuc

SEQ ID NO: 1375402 - RNA, 21 nt, Human
ccugucucuucucgucuuccc

SEQ ID NO: 1375403 - RNA, 19 nt, Human
cgacagagccugcauauuu

SEQ ID NO: 1375404 - RNA, 22 nt, Human
cgccauguuggccaggcugguc

SEQ ID NO: 1375405 - RNA, 24 nt, Human
cgccauguuggccaggcuggucuu

SEQ ID NO: 1375406 - RNA, 19 nt, Human
cuagaccacccccaccaga

SEQ ID NO: 1375407 - RNA, 22 nt, Human
cuagaccacccccaccagaucc

SEQ ID NO: 1375408 - RNA, 24 nt, Human
cuagcugccucuucggauuucucc

SEQ ID NO: 1375409 - RNA, 20 nt, Human
cucacagcaggcuggccucc

SEQ ID NO: 1375410 - RNA, 21 nt, Human
cucacucgcccugucccccca

SEQ ID NO: 1375411 - RNA, 24 nt, Human
cucacucugucacccaggcuggag

SEQ ID NO: 1375412 - RNA, 21 nt, Human
cuccaauccucuauuuaacca

SEQ ID NO: 1375413 - RNA, 21 nt, Human
cucccaacccugccuucagcu

SEQ ID NO: 1375414 - RNA, 19 nt, Human
cucccagagcugccguccc

SEQ ID NO: 1375415 - RNA, 24 nt, Human
cuccccagaugcacaguuagccga

SEQ ID NO: 1375416 - RNA, 24 nt, Human
cuccugccaccaagcccuugccag

SEQ ID NO: 1375417 - RNA, 18 nt, Human
cuccuucuugucuuccuc

SEQ ID NO: 1375418 - RNA, 18 nt, Human
cucucccuagcugccucu

SEQ ID NO: 1375419 - RNA, 18 nt, Human
cucucucuucugcacccc

SEQ ID NO: 1375420 - RNA, 22 nt, Human
cucugccuaccucccacucucc

SEQ ID NO: 1375421 - RNA, 18 nt, Human
cucugugcuaacuagccc

SEQ ID NO: 1375422 - RNA, 23 nt, Human
cugaacuagugaucugagagaca

SEQ ID NO: 1375423 - RNA, 18 nt, Human
cugcaccccucugccucu

SEQ ID NO: 1375424 - RNA, 21 nt, Human
cugcagugcuuucucuuuuaa

SEQ ID NO: 1375425 - RNA, 23 nt, Human
cugcagugcuuucucuuuuaauc

SEQ ID NO: 1375426 - RNA, 27 nt, Human
cugccuccugaguucaagcaauuuuuu

SEQ ID NO: 1375427 - RNA, 24 nt, Human
cuggcccugcacuuauuagcuggg

SEQ ID NO: 1375428 - RNA, 21 nt, Human
cuggcccugcccuccucccca

SEQ ID NO: 1375429 - RNA, 21 nt, Human
cugggauuauaggugugagcc

SEQ ID NO: 1375430 - RNA, 21 nt, Human
cugggcagccauggcuccagc

SEQ ID NO: 1375431 - RNA, 20 nt, Human
cugguggagaaggagcuggg

SEQ ID NO: 1375432 - RNA, 23 nt, Human
cugguggagaaggagcugggauu

SEQ ID NO: 1375433 - RNA, 21 nt, Human
cugucgcagccuccugaguag

SEQ ID NO: 1375434 - RNA, 19 nt, Human
cuuccaccugauaagaaug

SEQ ID NO: 1375435 - RNA, 19 nt, Human
cuucuccuucuugucuucc

SEQ ID NO: 1375436 - RNA, 18 nt, Human
cuugagcauccuuaugac

SEQ ID NO: 1375437 - RNA, 24 nt, Human
cuugcaagauggcgcacucacaug

SEQ ID NO: 1375438 - RNA, 18 nt, Human
cuuucuaggccacuugua

SEQ ID NO: 1375439 - RNA, 18 nt, Human
gaaauggaagguggggug

SEQ ID NO: 1375440 - RNA, 20 nt, Human
gaaggugggguggaggaagc

SEQ ID NO: 1375441 - RNA, 24 nt, Human
gaccucaggugauccacucaccuc

SEQ ID NO: 1375442 - RNA, 19 nt, Human
gacuguaacccaacccccu

SEQ ID NO: 1375443 - RNA, 18 nt, Human
gacuuagggugcuggggg

SEQ ID NO: 1375444 - RNA, 19 nt, Human
gagaaagccacggcacaga

SEQ ID NO: 1375445 - RNA, 22 nt, Human
gagagauaggguuucgccaugu

SEQ ID NO: 1375446 - RNA, 21 nt, Human
gagcucuaggacccugcccaa

SEQ ID NO: 1375447 - RNA, 25 nt, Human
gaguaguugggauuacaggcaccug

SEQ ID NO: 1375448 - RNA, 24 nt, Human
gauuacaggcaccugccaccaugc

SEQ ID NO: 1375449 - RNA, 18 nt, Human
gauuauaggugugagcca

SEQ ID NO: 1375450 - RNA, 20 nt, Human
gauuauaggugugagccacc

SEQ ID NO: 1375451 - RNA, 24 nt, Human
gauuauaggugugagccaccucgu

SEQ ID NO: 1375452 - RNA, 18 nt, Human
gauucacacccagccucc

SEQ ID NO: 1375453 - RNA, 24 nt, Human
gccauguuggccaggcuggucuug

SEQ ID NO: 1375454 - RNA, 22 nt, Human
gcccggcuaauuuuuguauuuu

SEQ ID NO: 1375455 - RNA, 21 nt, Human
gcccuugacacucccaacccu

SEQ ID NO: 1375456 - RNA, 21 nt, Human
gccuaccucccacucucccua

SEQ ID NO: 1375457 - RNA, 21 nt, Human
gccucagagccagggcuucug

SEQ ID NO: 1375458 - RNA, 24 nt, Human
gccucuucggauuucuccaaccuu

SEQ ID NO: 1375459 - RNA, 22 nt, Human
gcucaacuggggcuggaagagc

SEQ ID NO: 1375460 - RNA, 22 nt, Human
gcucagccggggcugguggggc

SEQ ID NO: 1375461 - RNA, 19 nt, Human
gcucccucagcugaugccc

SEQ ID NO: 1375462 - RNA, 19 nt, Human
gcucccucagcugaugccc

SEQ ID NO: 1375463 - RNA, 21 nt, Human
gcuggaggagccgcgggccug

SEQ ID NO: 1375464 - RNA, 20 nt, Human
gcuggccuccuuucucuccc

SEQ ID NO: 1375465 - RNA, 20 nt, Human
gcuucuccuucuugucuucc

SEQ ID NO: 1375466 - RNA, 18 nt, Human
ggacgugacccuacccuc

SEQ ID NO: 1375467 - RNA, 21 nt, Human
ggagcaggccagaagggugcu

SEQ ID NO: 1375468 - RNA, 19 nt, Human
ggagcugggauucacaccc

SEQ ID NO: 1375469 - RNA, 22 nt, Human
ggagcugggauucacacccagc

SEQ ID NO: 1375470 - RNA, 25 nt, Human
ggcagucaucacagacuguaggugc

SEQ ID NO: 1375471 - RNA, 26 nt, Human
ggccucagagccagggcuucuguggu

SEQ ID NO: 1375472 - RNA, 21 nt, Human
ggccuggccugucucuucucg

SEQ ID NO: 1375473 - RNA, 24 nt, Human
ggcuggucuugaauuccugaccuc

SEQ ID NO: 1375474 - RNA, 20 nt, Human
gggcugcagucaucugaagg

SEQ ID NO: 1375475 - RNA, 23 nt, Human
gggcugguggggccgccccucuu

SEQ ID NO: 1375476 - RNA, 18 nt, Human
gggggucagcucagccgg

SEQ ID NO: 1375477 - RNA, 21 nt, Human
ggguuucgccauguuggccag

SEQ ID NO: 1375478 - RNA, 22 nt, Human
ggguuucgccauguuggccagg

SEQ ID NO: 1375479 - RNA, 19 nt, Human
ggucuugaauuccugaccu

SEQ ID NO: 1375480 - RNA, 24 nt, Human
gguuuggggacucagccugugcua

SEQ ID NO: 1375481 - RNA, 18 nt, Human
guaguugggauuacaggc

SEQ ID NO: 1375482 - RNA, 24 nt, Human
gugauccacucaccucggccuccc

SEQ ID NO: 1375483 - RNA, 22 nt, Human
gugcuuguguggggugaggugc

SEQ ID NO: 1375484 - RNA, 20 nt, Human
gugguccuggacuaacugag

SEQ ID NO: 1375485 - RNA, 26 nt, Human
guggugugccggccccucaugcuggg

SEQ ID NO: 1375486 - RNA, 21 nt, Human
guguacacuggguuuuacaua

SEQ ID NO: 1375487 - RNA, 22 nt, Human
guuaggaaaaggagaauaucca

SEQ ID NO: 1375488 - RNA, 28 nt, Human
uaauauuucuuccuuuuuuuuuuucucu

SEQ ID NO: 1375489 - RNA, 18 nt, Human
uaaucugcauuucuccuu

SEQ ID NO: 1375490 - RNA, 23 nt, Human
uacaggcaccugccaccaugccc

SEQ ID NO: 1375491 - RNA, 20 nt, Human
uacccucacagcaggcuggc

SEQ ID NO: 1375492 - RNA, 18 nt, Human
uacgacagagccugcaua

SEQ ID NO: 1375493 - RNA, 19 nt, Human
uagaacauuccugggcuca

SEQ ID NO: 1375494 - RNA, 22 nt, Human
uagaccacccccaccagauccc

SEQ ID NO: 1375495 - RNA, 18 nt, Human
uagcuccauggaaagggc

SEQ ID NO: 1375496 - RNA, 21 nt, Human
uagcugccucuucggauuucu

SEQ ID NO: 1375497 - RNA, 24 nt, Human
uaggagagauaggguuucgccaug

SEQ ID NO: 1375498 - RNA, 22 nt, Human
uaggaugacucuuucuccccag

SEQ ID NO: 1375499 - RNA, 23 nt, Human
uaggccucugggcagccauggcu

SEQ ID NO: 1375500 - RNA, 24 nt, Human
uaggguuucgccauguuggccagg

SEQ ID NO: 1375501 - RNA, 18 nt, Human
uagugcugguugccggca

SEQ ID NO: 1375502 - RNA, 18 nt, Human
uaguugggauuacaggca

SEQ ID NO: 1375503 - RNA, 20 nt, Human
uaugccugguuuccacuccc

SEQ ID NO: 1375504 - RNA, 20 nt, Human
uauuccaacguuucaacagg

SEQ ID NO: 1375505 - RNA, 24 nt, Human
uauuucuuccuuuuuuuuuuucuc

SEQ ID NO: 1375506 - RNA, 26 nt, Human
ucaaaaagaaucauuucuuuucuccu

SEQ ID NO: 1375507 - RNA, 18 nt, Human
ucaaaacagcagcuccua

SEQ ID NO: 1375508 - RNA, 24 nt, Human
ucacccaggcuggagugcaguagu

SEQ ID NO: 1375509 - RNA, 24 nt, Human
ucacucugucacccaggcuggagu

SEQ ID NO: 1375510 - RNA, 18 nt, Human
ucagcucauuucuuccaa

SEQ ID NO: 1375511 - RNA, 18 nt, Human
ucagguccucucccuccu

SEQ ID NO: 1375512 - RNA, 20 nt, Human
ucaggugauccacucaccuc

SEQ ID NO: 1375513 - RNA, 23 nt, Human
ucccaaagugcugggauuauagg

SEQ ID NO: 1375514 - RNA, 22 nt, Human
uccccagaugcacaguuagcuc

SEQ ID NO: 1375515 - RNA, 21 nt, Human
ucccucagcugaugcccugcu

SEQ ID NO: 1375516 - RNA, 18 nt, Human
ucccucuuuguugccucu

SEQ ID NO: 1375517 - RNA, 24 nt, Human
uccugaguaguugggauuacaggc

SEQ ID NO: 1375518 - RNA, 21 nt, Human
uccugaguucaagcaauuuuc

SEQ ID NO: 1375519 - RNA, 24 nt, Human
uccugaguucaagcaauuuuccug

SEQ ID NO: 1375520 - RNA, 18 nt, Human
uccuugggccuggccugu

SEQ ID NO: 1375521 - RNA, 22 nt, Human
ucgccauguuggccaggcuggu

SEQ ID NO: 1375522 - RNA, 24 nt, Human
ucgccauguuggccaggcuggucu

SEQ ID NO: 1375523 - RNA, 18 nt, Human
ucggccucccaaagugcu

SEQ ID NO: 1375524 - RNA, 21 nt, Human
ucuagcccacguuuaccacac

SEQ ID NO: 1375525 - RNA, 22 nt, Human
ucucacucugucacccaggcug

SEQ ID NO: 1375526 - RNA, 23 nt, Human
ucucacucugucacccaggcugg

SEQ ID NO: 1375527 - RNA, 24 nt, Human
ucucacucugucacccaggcugga

SEQ ID NO: 1375528 - RNA, 26 nt, Human
ucucacucugucacccaggcuggagu

SEQ ID NO: 1375529 - RNA, 27 nt, Human
ucucacucugucacccaggcuggagug

SEQ ID NO: 1375530 - RNA, 21 nt, Human
ucucuaaaucaacauuagcuu

SEQ ID NO: 1375531 - RNA, 24 nt, Human
ucugcaccccucugccucuggccu

SEQ ID NO: 1375532 - RNA, 24 nt, Human
ucugucacccaggcuggagugcag

SEQ ID NO: 1375533 - RNA, 21 nt, Human
ugacagggcggggggucagcu

SEQ ID NO: 1375534 - RNA, 19 nt, Human
ugaccucaggugauccacu

SEQ ID NO: 1375535 - RNA, 20 nt, Human
ugaccucaggugauccacuc

SEQ ID NO: 1375536 - RNA, 21 nt, Human
ugacucuuucuccccagaugc

SEQ ID NO: 1375537 - RNA, 22 nt, Human
ugagaaagccacggcacagagc

SEQ ID NO: 1375538 - RNA, 19 nt, Human
ugagcacacacacaacccu

SEQ ID NO: 1375539 - RNA, 30 nt, Human
ugaguaccucucacuguguaacaaauuucu

SEQ ID NO: 1375540 - RNA, 21 nt, Human
ugagucucacucugucaccca

SEQ ID NO: 1375541 - RNA, 21 nt, Human
ugaguucaagcaauuuuccug

SEQ ID NO: 1375542 - RNA, 24 nt, Human
ugauccacucaccucggccuccca

SEQ ID NO: 1375543 - RNA, 22 nt, Human
ugccaguggugggacuguaacc

SEQ ID NO: 1375544 - RNA, 22 nt, Human
ugcccaggcaaaggggcucugc

SEQ ID NO: 1375545 - RNA, 24 nt, Human
ugcccggcuaauuuuuguauuuuu

SEQ ID NO: 1375546 - RNA, 18 nt, Human
ugcccugcuuccauuccc

SEQ ID NO: 1375547 - RNA, 21 nt, Human
ugcgcaacaggaggccccaug

SEQ ID NO: 1375548 - RNA, 19 nt, Human
ugcucucucuucugcaccc

SEQ ID NO: 1375549 - RNA, 20 nt, Human
ugcuggaggagccgcgggcc

SEQ ID NO: 1375550 - RNA, 19 nt, Human
ugcuggggaaagaggggac

SEQ ID NO: 1375551 - RNA, 24 nt, Human
ugcuucagguuaagggucacaggc

SEQ ID NO: 1375552 - RNA, 19 nt, Human
uggaaggugggguggagga

SEQ ID NO: 1375553 - RNA, 23 nt, Human
uggaaggugggguggaggaagca

SEQ ID NO: 1375554 - RNA, 21 nt, Human
uggaggaagcagguggcuuua

SEQ ID NO: 1375555 - RNA, 24 nt, Human
uggagugcaguagugcaaucuugg

SEQ ID NO: 1375556 - RNA, 21 nt, Human
uggcaagccacuuucuuaaca

SEQ ID NO: 1375557 - RNA, 22 nt, Human
uggcaagccacuuucuuaacau

SEQ ID NO: 1375558 - RNA, 19 nt, Human
uggcagcugcccucuaugu

SEQ ID NO: 1375559 - RNA, 24 nt, Human
uggccaggcuggucuugaauuccu

SEQ ID NO: 1375560 - RNA, 23 nt, Human
uggcuuccccugaacuagugauc

SEQ ID NO: 1375561 - RNA, 21 nt, Human
ugggagaagcuuagccagagg

SEQ ID NO: 1375562 - RNA, 21 nt, Human
ugggauuacaggcaccugcca

SEQ ID NO: 1375563 - RNA, 22 nt, Human
ugggauuacaggcaccugccac

SEQ ID NO: 1375564 - RNA, 24 nt, Human
ugggauuacaggcaccugccacca

SEQ ID NO: 1375565 - RNA, 25 nt, Human
ugggauuacaggcaccugccaccau

SEQ ID NO: 1375566 - RNA, 18 nt, Human
ugggauuauaggugugag

SEQ ID NO: 1375567 - RNA, 21 nt, Human
ugggauuauaggugugagcca

SEQ ID NO: 1375568 - RNA, 22 nt, Human
ugggauuauaggugugagccac

SEQ ID NO: 1375569 - RNA, 23 nt, Human
ugggauuauaggugugagccacc

SEQ ID NO: 1375570 - RNA, 23 nt, Human
ugggauuauaggugugagccacc

SEQ ID NO: 1375571 - RNA, 23 nt, Human
ugggauuauaggugugagccacc

SEQ ID NO: 1375572 - RNA, 25 nt, Human
ugggauuauaggugugagccaccuc

SEQ ID NO: 1375573 - RNA, 21 nt, Human
ugggauucacacccagccucc

SEQ ID NO: 1375574 - RNA, 22 nt, Human
ugggccucagagccaggacccu

SEQ ID NO: 1375575 - RNA, 21 nt, Human
uggggccgccccucuuccugu

SEQ ID NO: 1375576 - RNA, 23 nt, Human
uggggugaggugcuggcccugcc

SEQ ID NO: 1375577 - RNA, 21 nt, Human
uggggugaggugcuggcccuu

SEQ ID NO: 1375578 - RNA, 22 nt, Human
uggguuuuggcaagccacuuuc

SEQ ID NO: 1375579 - RNA, 23 nt, Human
uguaaaauggauauaauaaaagc

SEQ ID NO: 1375580 - RNA, 18 nt, Human
uguccaccacuccccucc

SEQ ID NO: 1375581 - RNA, 24 nt, Human
ugucucacucgcccugucccccca

SEQ ID NO: 1375582 - RNA, 26 nt, Human
ugucucacucgcccuguccccccagc

SEQ ID NO: 1375583 - RNA, 19 nt, Human
ugugauacugauuuccaga

SEQ ID NO: 1375584 - RNA, 22 nt, Human
ugugcugggagcccacgguuga

SEQ ID NO: 1375585 - RNA, 24 nt, Human
uuaagaugucagcuggggcugcag

SEQ ID NO: 1375586 - RNA, 24 nt, Human
uuagcagcuuaaaacaacaauaaa

SEQ ID NO: 1375587 - RNA, 24 nt, Human
uuaggagagauaggguuucgccau

SEQ ID NO: 1375588 - RNA, 23 nt, Human
uucagccuucagggccuugccug

SEQ ID NO: 1375589 - RNA, 21 nt, Human
uuccaagccccccaggagcuc

SEQ ID NO: 1375590 - RNA, 21 nt, Human
uuccaagccccccaggagcuc

SEQ ID NO: 1375591 - RNA, 22 nt, Human
uuccaagccccccaggagcucu

SEQ ID NO: 1375592 - RNA, 22 nt, Human
uugccugucuacccaagaguga

SEQ ID NO: 1375593 - RNA, 23 nt, Human
uuucgccauguuggccaggcugu

SEQ ID NO: 1375594 - RNA, 23 nt, Human
uuucugggagucauaaauuuggg

SEQ ID NO: 1375595 - RNA, 24 nt, Human
uuuggcaagccacuuucuuaacaa

SEQ ID NO: 1375596 - RNA, 22 nt, Human
uuuuacagcacacuuuaaacug

SEQ ID NO: 1375597 - RNA, 20 nt, Human
uuuuguauuuuuaggagaga

SEQ ID NO: 1375598 - RNA, 23 nt, Human
uuuuuaggagagauaggguuucg

SEQ ID NO: 1375599 - RNA, 24 nt, Human
uuuuuaggagagauaggguuucgc

SEQ ID NO: 1375600 - RNA, 18 nt, Human
uuuuuguauuuuuaggag

SEQ ID NO: 1375601 - RNA, 18 nt, Human
aaaacaggaaaaucgagg

SEQ ID NO: 1375602 - RNA, 21 nt, Human
aacaggacaacccggagucuc

SEQ ID NO: 1375603 - RNA, 21 nt, Human
aaccaguuucuucccagcccc

SEQ ID NO: 1375604 - RNA, 22 nt, Human
aaccaguuucuucccagcccca

SEQ ID NO: 1375605 - RNA, 18 nt, Human
aagcccagaaagaacagg

SEQ ID NO: 1375606 - RNA, 20 nt, Human
aaggcagacagaggggcugg

SEQ ID NO: 1375607 - RNA, 23 nt, Human
acaaaggcaaacucuaaaagcug

SEQ ID NO: 1375608 - RNA, 23 nt, Human
acacacacacacacacacacaca

SEQ ID NO: 1375609 - RNA, 23 nt, Human
acacacacacacacacacacaca

SEQ ID NO: 1375610 - RNA, 23 nt, Human
acacacacacacacacacacaca

SEQ ID NO: 1375611 - RNA, 26 nt, Human
acacacacacacacacacguauagau

SEQ ID NO: 1375612 - RNA, 25 nt, Human
acacacacacacacguauagaucac

SEQ ID NO: 1375613 - RNA, 21 nt, Human
acacggaaacaccugggggua

SEQ ID NO: 1375614 - RNA, 20 nt, Human
accagcagaggcucaggggg

SEQ ID NO: 1375615 - RNA, 20 nt, Human
accccaguacccagggcuaa

SEQ ID NO: 1375616 - RNA, 24 nt, Human
acccccaccccacgcccccagccc

SEQ ID NO: 1375617 - RNA, 29 nt, Human
accgccugcauacacacacacacacacac

SEQ ID NO: 1375618 - RNA, 20 nt, Human
accuccagaugucucauccu

SEQ ID NO: 1375619 - RNA, 23 nt, Human
accuucacaaggcagacagaggg

SEQ ID NO: 1375620 - RNA, 22 nt, Human
acguaucuguauuacuaaccca

SEQ ID NO: 1375621 - RNA, 19 nt, Human
agacacacacucaaguaca

SEQ ID NO: 1375622 - RNA, 19 nt, Human
agagagaagcaaaacagga

SEQ ID NO: 1375623 - RNA, 24 nt, Human
agaugagcaagcccagaaagaaca

SEQ ID NO: 1375624 - RNA, 19 nt, Human
agcacagaccuccaagagg

SEQ ID NO: 1375625 - RNA, 19 nt, Human
agcacccugcuugcccagg

SEQ ID NO: 1375626 - RNA, 18 nt, Human
agcuccuaaccaccccuc

SEQ ID NO: 1375627 - RNA, 18 nt, Human
aggaagaaagagggcagg

SEQ ID NO: 1375628 - RNA, 19 nt, Human
aggaggggaggagguggag

SEQ ID NO: 1375629 - RNA, 19 nt, Human
aggcagacacccccacccc

SEQ ID NO: 1375630 - RNA, 18 nt, Human
aggcauaggcugcacaca

SEQ ID NO: 1375631 - RNA, 21 nt, Human
aggccccuacaccagcaccaa

SEQ ID NO: 1375632 - RNA, 18 nt, Human
aggcgcuggggcugcucu

SEQ ID NO: 1375633 - RNA, 25 nt, Human
aggggguggcgauuccucuccuuuc

SEQ ID NO: 1375634 - RNA, 19 nt, Human
agggguggggugggacagg

SEQ ID NO: 1375635 - RNA, 24 nt, Human
agggguggggugggacaggguugg

SEQ ID NO: 1375636 - RNA, 18 nt, Human
agggucggggacuguggg

SEQ ID NO: 1375637 - RNA, 24 nt, Human
agggugguggaggagcggcccugg

SEQ ID NO: 1375638 - RNA, 23 nt, Human
aucccauccgcccucccgcuuca

SEQ ID NO: 1375639 - RNA, 24 nt, Human
augggcacacacacagccuccuac

SEQ ID NO: 1375640 - RNA, 22 nt, Human
caacgacaguagaaagcuuuua

SEQ ID NO: 1375641 - RNA, 18 nt, Human
caagcccagaaagaacag

SEQ ID NO: 1375642 - RNA, 24 nt, Human
caagugcacuaaagagggagacua

SEQ ID NO: 1375643 - RNA, 18 nt, Human
cacacacacacacacaca

SEQ ID NO: 1375644 - RNA, 20 nt, Human
cacacacacacacacacaca

SEQ ID NO: 1375645 - RNA, 20 nt, Human
cacacacacacacacacaca

SEQ ID NO: 1375646 - RNA, 20 nt, Human
cacacacacacacacacaca

SEQ ID NO: 1375647 - RNA, 20 nt, Human
cacacacacacacacacaca

SEQ ID NO: 1375648 - RNA, 20 nt, Human
cacacacacacacacacaca

SEQ ID NO: 1375649 - RNA, 20 nt, Human
cacacacacacacacacaca

SEQ ID NO: 1375650 - RNA, 20 nt, Human
cacacacacacacacacaca

SEQ ID NO: 1375651 - RNA, 22 nt, Human
cacacacacacacacacacaca

SEQ ID NO: 1375652 - RNA, 22 nt, Human
cacacacacacacacacacaca

SEQ ID NO: 1375653 - RNA, 22 nt, Human
cacacacacacacacacacaca

SEQ ID NO: 1375654 - RNA, 26 nt, Human
cacacacacacacacacacacacaca

SEQ ID NO: 1375655 - RNA, 26 nt, Human
cacacacacacacacacacacacaca

SEQ ID NO: 1375656 - RNA, 26 nt, Human
cacacacacacacacacacacacaca

SEQ ID NO: 1375657 - RNA, 26 nt, Human
cacacacacacacacacacacacacg

SEQ ID NO: 1375658 - RNA, 26 nt, Human
cacacacacacacacacacacacgua

SEQ ID NO: 1375659 - RNA, 26 nt, Human
cacacacacacacacacacacguaua

SEQ ID NO: 1375660 - RNA, 27 nt, Human
cacacacacacacacacacguauagau

SEQ ID NO: 1375661 - RNA, 28 nt, Human
cacacagacacacacucaaguacacggu

SEQ ID NO: 1375662 - RNA, 20 nt, Human
cacacgagccggacgcacac

SEQ ID NO: 1375663 - RNA, 19 nt, Human
cacacgccuccacacacac

SEQ ID NO: 1375664 - RNA, 24 nt, Human
cacagcaccagcagaggcucaggg

SEQ ID NO: 1375665 - RNA, 23 nt, Human
caccagcaccaagugaccagggu

SEQ ID NO: 1375666 - RNA, 21 nt, Human
cacggggagaggccaguccca

SEQ ID NO: 1375667 - RNA, 20 nt, Human
cacugcaugacccccucugc

SEQ ID NO: 1375668 - RNA, 22 nt, Human
cagacacauaaccgccugcaua

SEQ ID NO: 1375669 - RNA, 22 nt, Human
cagacacccccaccccacgccc

SEQ ID NO: 1375670 - RNA, 18 nt, Human
cagcacagcaccagcaga

SEQ ID NO: 1375671 - RNA, 20 nt, Human
cagccccacccaccacccca

SEQ ID NO: 1375672 - RNA, 20 nt, Human
cagcugaggcaccccuggca

SEQ ID NO: 1375673 - RNA, 21 nt, Human
cagcuuccuccuagccuggga

SEQ ID NO: 1375674 - RNA, 22 nt, Human
caggagaaucaagcaucugccg

SEQ ID NO: 1375675 - RNA, 25 nt, Human
cauacacacacacacacacacacac

SEQ ID NO: 1375676 - RNA, 25 nt, Human
cauacacaugaagagccgagugugc

SEQ ID NO: 1375677 - RNA, 21 nt, Human
caucccauccgcccucccgcu

SEQ ID NO: 1375678 - RNA, 23 nt, Human
caugaaaacucuccaguuucacc

SEQ ID NO: 1375679 - RNA, 20 nt, Human
ccaagugaccagggucacca

SEQ ID NO: 1375680 - RNA, 20 nt, Human
ccaccgugcucugagcagca

SEQ ID NO: 1375681 - RNA, 18 nt, Human
ccagcaccaagugaccag

SEQ ID NO: 1375682 - RNA, 18 nt, Human
ccagcagaggcucagggg

SEQ ID NO: 1375683 - RNA, 19 nt, Human
ccagggccuggcugugccc

SEQ ID NO: 1375684 - RNA, 23 nt, Human
cccaccucggggaacccucugga

SEQ ID NO: 1375685 - RNA, 26 nt, Human
cccagaaagaacaggacaacccggag

SEQ ID NO: 1375686 - RNA, 21 nt, Human
cccagaccucagggcugaguc

SEQ ID NO: 1375687 - RNA, 24 nt, Human
cccagccccacccaccaccccaac

SEQ ID NO: 1375688 - RNA, 20 nt, Human
cccagccccucucugucucc

SEQ ID NO: 1375689 - RNA, 23 nt, Human
cccagggcuaaggcugagaaggc

SEQ ID NO: 1375690 - RNA, 19 nt, Human
cccaugccuggcccugaga

SEQ ID NO: 1375691 - RNA, 22 nt, Human
ccccaacgacaguagaaagcuu

SEQ ID NO: 1375692 - RNA, 18 nt, Human
ccccacccaccaccccaa

SEQ ID NO: 1375693 - RNA, 20 nt, Human
ccccaccccacgcccccagc

SEQ ID NO: 1375694 - RNA, 18 nt, Human
ccccacgcccccagcccc

SEQ ID NO: 1375695 - RNA, 20 nt, Human
ccccacgcccccagccccuc

SEQ ID NO: 1375696 - RNA, 23 nt, Human
ccccguacaggggccucccaacg

SEQ ID NO: 1375697 - RNA, 19 nt, Human
cccggagucucuaaggcac

SEQ ID NO: 1375698 - RNA, 20 nt, Human
cccggccuauagcuccuaac

SEQ ID NO: 1375699 - RNA, 24 nt, Human
cccuacaccagcaccaagugacca

SEQ ID NO: 1375700 - RNA, 26 nt, Human
cccucccgcuucaagugcacuaaaga

SEQ ID NO: 1375701 - RNA, 19 nt, Human
cccucgauggcagguccca

SEQ ID NO: 1375702 - RNA, 23 nt, Human
cccuggaagggcacaggccccua

SEQ ID NO: 1375703 - RNA, 19 nt, Human
ccggagucucuaaggcacg

SEQ ID NO: 1375704 - RNA, 22 nt, Human
ccucacgcagggcagacacccc

SEQ ID NO: 1375705 - RNA, 25 nt, Human
ccucacuguggaauugggcggaggc

SEQ ID NO: 1375706 - RNA, 20 nt, Human
ccuccacacacacacucccc

SEQ ID NO: 1375707 - RNA, 22 nt, Human
ccuccacacacacacuccccag

SEQ ID NO: 1375708 - RNA, 19 nt, Human
ccucucugucuccugcacc

SEQ ID NO: 1375709 - RNA, 21 nt, Human
ccucucugucuccugcacccc

SEQ ID NO: 1375710 - RNA, 26 nt, Human
cgccugcauacacacacacacacagu

SEQ ID NO: 1375711 - RNA, 26 nt, Human
cggagucucuaaggcacgacucacac

SEQ ID NO: 1375712 - RNA, 21 nt, Human
cggcaggaauucuguuccacg

SEQ ID NO: 1375713 - RNA, 23 nt, Human
cggccuauagcuccuaaccaccc

SEQ ID NO: 1375714 - RNA, 19 nt, Human
cggggaggaacccucgaug

SEQ ID NO: 1375715 - RNA, 18 nt, Human
cucaggggguggccaccg

SEQ ID NO: 1375716 - RNA, 19 nt, Human
cucaucgccuacgucuuua

SEQ ID NO: 1375717 - RNA, 23 nt, Human
cuccaggugagggagggacagga

SEQ ID NO: 1375718 - RNA, 21 nt, Human
cuccccugccaacuucacccc

SEQ ID NO: 1375719 - RNA, 23 nt, Human
cuccugcaccccacccacucacu

SEQ ID NO: 1375720 - RNA, 22 nt, Human
cucggcagaaucuucuaugcca

SEQ ID NO: 1375721 - RNA, 22 nt, Human
cugcaugacccccucugcucuc

SEQ ID NO: 1375722 - RNA, 23 nt, Human
cugccaacuucaccccaguaccc

SEQ ID NO: 1375723 - RNA, 21 nt, Human
cuucacaaggcagacagaggg

SEQ ID NO: 1375724 - RNA, 20 nt, Human
cuucccagccccacccacca

SEQ ID NO: 1375725 - RNA, 22 nt, Human
gaaagaacaggacaacccggag

SEQ ID NO: 1375726 - RNA, 21 nt, Human
gacaggguuggggggagauga

SEQ ID NO: 1375727 - RNA, 24 nt, Human
gaccuggccccugccaccuucaca

SEQ ID NO: 1375728 - RNA, 24 nt, Human
gagggacaggaugugguccuaugu

SEQ ID NO: 1375729 - RNA, 22 nt, Human
gagggguggggugggacagggu

SEQ ID NO: 1375730 - RNA, 20 nt, Human
gcacacgcucaccuccagau

SEQ ID NO: 1375731 - RNA, 18 nt, Human
gccaccgugcucugagca

SEQ ID NO: 1375732 - RNA, 21 nt, Human
gccaggaggugggccuggggu

SEQ ID NO: 1375733 - RNA, 20 nt, Human
gccccacccaccaccccaac

SEQ ID NO: 1375734 - RNA, 21 nt, Human
gcccugccugaacucugcugu

SEQ ID NO: 1375735 - RNA, 24 nt, Human
gccuuuggggagaugaggcgcugg

SEQ ID NO: 1375736 - RNA, 19 nt, Human
ggaaagagcugccucggca

SEQ ID NO: 1375737 - RNA, 23 nt, Human
ggagaggccagucccaccucggg

SEQ ID NO: 1375738 - RNA, 23 nt, Human
ggagaugagcaagcccagaaaga

SEQ ID NO: 1375739 - RNA, 22 nt, Human
ggagaugaggcgcuggggcugc

SEQ ID NO: 1375740 - RNA, 23 nt, Human
ggagaugaggcgcuggggcugcu

SEQ ID NO: 1375741 - RNA, 19 nt, Human
ggaggaacuucagcagugg

SEQ ID NO: 1375742 - RNA, 20 nt, Human
ggaggaacuucagcagugga

SEQ ID NO: 1375743 - RNA, 20 nt, Human
ggaggggaggagguggaggg

SEQ ID NO: 1375744 - RNA, 21 nt, Human
ggccaggaggugggccugggg

SEQ ID NO: 1375745 - RNA, 19 nt, Human
ggcccuggaagacucggca

SEQ ID NO: 1375746 - RNA, 22 nt, Human
gggaggagguggagggaagagg

SEQ ID NO: 1375747 - RNA, 22 nt, Human
gggcacaggccccuacaccagc

SEQ ID NO: 1375748 - RNA, 21 nt, Human
ggggaggaacccucgauggca

SEQ ID NO: 1375749 - RNA, 23 nt, Human
ggggaggagguggagggaagagg

SEQ ID NO: 1375750 - RNA, 18 nt, Human
gggugcccucccucacag

SEQ ID NO: 1375751 - RNA, 20 nt, Human
ggguggccaccgugcucuga

SEQ ID NO: 1375752 - RNA, 21 nt, Human
gguagacagacacauaaccgc

SEQ ID NO: 1375753 - RNA, 21 nt, Human
gguggcuccuccccgcccccc

SEQ ID NO: 1375754 - RNA, 20 nt, Human
guagacagacacauaaccgc

SEQ ID NO: 1375755 - RNA, 19 nt, Human
gugcaugugugcaccacac

SEQ ID NO: 1375756 - RNA, 30 nt, Human
uaaaagcucaaaccaguuucuucccagccc

SEQ ID NO: 1375757 - RNA, 21 nt, Human
uaacauggucuugauuuuucu

SEQ ID NO: 1375758 - RNA, 25 nt, Human
uacacacacacacacacacacacac

SEQ ID NO: 1375759 - RNA, 22 nt, Human
uacacacgagccggacgcacac

SEQ ID NO: 1375760 - RNA, 22 nt, Human
uacaccagcaccaagugaccag

SEQ ID NO: 1375761 - RNA, 19 nt, Human
uacacggaaacaccugggg

SEQ ID NO: 1375762 - RNA, 25 nt, Human
uacccagggcuaaggcugagaaggc

SEQ ID NO: 1375763 - RNA, 24 nt, Human
uagacagacacauaaccgccugca

SEQ ID NO: 1375764 - RNA, 22 nt, Human
uaggccugggagcaggaaccag

SEQ ID NO: 1375765 - RNA, 21 nt, Human
ucaagcucuccccugccaacu

SEQ ID NO: 1375766 - RNA, 19 nt, Human
ucacaaggcagacagaggg

SEQ ID NO: 1375767 - RNA, 18 nt, Human
ucagcaguggagguaugg

SEQ ID NO: 1375768 - RNA, 24 nt, Human
ucagcaguggagguaugggagggg

SEQ ID NO: 1375769 - RNA, 20 nt, Human
ucagggaggcgaagugucaa

SEQ ID NO: 1375770 - RNA, 23 nt, Human
uccacacacacacuccccagggg

SEQ ID NO: 1375771 - RNA, 25 nt, Human
uccacggcugguuucugauucagcc

SEQ ID NO: 1375772 - RNA, 24 nt, Human
uccaguuucaccauuuaaaauaau

SEQ ID NO: 1375773 - RNA, 20 nt, Human
uccauugccccagaccucag

SEQ ID NO: 1375774 - RNA, 21 nt, Human
ucccagagcacccugcuugcc

SEQ ID NO: 1375775 - RNA, 21 nt, Human
ucccagccccacccaccaccc

SEQ ID NO: 1375776 - RNA, 22 nt, Human
ucccagccccacccaccacccc

SEQ ID NO: 1375777 - RNA, 22 nt, Human
ucccauccgcccucccgcuuca

SEQ ID NO: 1375778 - RNA, 19 nt, Human
uccccaggggccaagucuu

SEQ ID NO: 1375779 - RNA, 22 nt, Human
uccuccccgccccccaggaccc

SEQ ID NO: 1375780 - RNA, 23 nt, Human
uccugcaccccacccacucacug

SEQ ID NO: 1375781 - RNA, 22 nt, Human
ucuaugccagaaaugagugugg

SEQ ID NO: 1375782 - RNA, 26 nt, Human
ucucugucuccugcaccccacccacu

SEQ ID NO: 1375783 - RNA, 21 nt, Human
ucugagcagcaggcauaggcu

SEQ ID NO: 1375784 - RNA, 21 nt, Human
ucugcugugcugcuccaggug

SEQ ID NO: 1375785 - RNA, 24 nt, Human
ucuucccagccccacccaccaccc

SEQ ID NO: 1375786 - RNA, 19 nt, Human
ugaccagggccuggcugug

SEQ ID NO: 1375787 - RNA, 23 nt, Human
ugaccagggccuggcugugcccu

SEQ ID NO: 1375788 - RNA, 21 nt, Human
ugaggcaccccuggcagaccc

SEQ ID NO: 1375789 - RNA, 22 nt, Human
ugaggcaccccuggcagacccc

SEQ ID NO: 1375790 - RNA, 24 nt, Human
ugaggcaccccuggcagaccccga

SEQ ID NO: 1375791 - RNA, 28 nt, Human
ugcacacagacacacacucaaguacacg

SEQ ID NO: 1375792 - RNA, 25 nt, Human
ugcauacacacacacacacacacac

SEQ ID NO: 1375793 - RNA, 19 nt, Human
ugcaugugugcaccacaca

SEQ ID NO: 1375794 - RNA, 22 nt, Human
ugccagugcccaaccugauggg

SEQ ID NO: 1375795 - RNA, 25 nt, Human
ugccccagaccucagggcugagucu

SEQ ID NO: 1375796 - RNA, 18 nt, Human
ugccugaacucugcugug

SEQ ID NO: 1375797 - RNA, 22 nt, Human
ugcuugcccagggacuguggug

SEQ ID NO: 1375798 - RNA, 18 nt, Human
uggcaggaggggguggcg

SEQ ID NO: 1375799 - RNA, 19 nt, Human
uggcaggaggggguggcga

SEQ ID NO: 1375800 - RNA, 18 nt, Human
ugggacaggguugggggg

SEQ ID NO: 1375801 - RNA, 19 nt, Human
ugggaggggugggguggga

SEQ ID NO: 1375802 - RNA, 23 nt, Human
ugggcccaguggggacggggcug

SEQ ID NO: 1375803 - RNA, 23 nt, Human
uggggguagacagacacauaacc

SEQ ID NO: 1375804 - RNA, 19 nt, Human
uggggugggacaggguugg

SEQ ID NO: 1375805 - RNA, 20 nt, Human
uggguggggaccacgcagca

SEQ ID NO: 1375806 - RNA, 18 nt, Human
ugggugggugcccucccu

SEQ ID NO: 1375807 - RNA, 23 nt, Human
ugguggaggagcggcccuggaag

SEQ ID NO: 1375808 - RNA, 22 nt, Human
uguaugcaugcaggcucacaca

SEQ ID NO: 1375809 - RNA, 20 nt, Human
ugucaggcagaccuggcccc

SEQ ID NO: 1375810 - RNA, 18 nt, Human
ugugcaccacacauguau

SEQ ID NO: 1375811 - RNA, 22 nt, Human
ugugcaccacacauguaugcau

SEQ ID NO: 1375812 - RNA, 19 nt, Human
uucacaugggcacacacac

SEQ ID NO: 1375813 - RNA, 23 nt, Human
uucccagccccacccaccacccc

SEQ ID NO: 1375814 - RNA, 23 nt, Human
uuccucgcuccuggcucauccca

SEQ ID NO: 1375815 - RNA, 28 nt, Human
uuuuucuaucacaaacagagccuagcug

SEQ ID NO: 1375816 - RNA, 23 nt, Human
aaaaauaaucauaauaaucacac

SEQ ID NO: 1375817 - RNA, 22 nt, Human
aaggacaaugaggagggggugc

SEQ ID NO: 1375818 - RNA, 26 nt, Human
aaugcggccuccugugccgcccuggg

SEQ ID NO: 1375819 - RNA, 21 nt, Human
acccuacuccaccugcucagc

SEQ ID NO: 1375820 - RNA, 18 nt, Human
accugcgaugcugcugga

SEQ ID NO: 1375821 - RNA, 18 nt, Human
acucggccccgccugcgg

SEQ ID NO: 1375822 - RNA, 18 nt, Human
acugcccgaugccugcug

SEQ ID NO: 1375823 - RNA, 18 nt, Human
agcaccaggccuaccugc

SEQ ID NO: 1375824 - RNA, 23 nt, Human
auuugggcuuguauugggagcuu

SEQ ID NO: 1375825 - RNA, 23 nt, Human
caagcacugccuggagccaggga

SEQ ID NO: 1375826 - RNA, 19 nt, Human
caccagcaccaggccuacc

SEQ ID NO: 1375827 - RNA, 19 nt, Human
caccuggagcacaccugca

SEQ ID NO: 1375828 - RNA, 24 nt, Human
cacuucaccagcaccaggccuacc

SEQ ID NO: 1375829 - RNA, 26 nt, Human
ccaccuggagcacaccugcaguucgc

SEQ ID NO: 1375830 - RNA, 22 nt, Human
ccccgccugcggacccucugcc

SEQ ID NO: 1375831 - RNA, 22 nt, Human
cccgccugcggacccucugccc

SEQ ID NO: 1375832 - RNA, 21 nt, Human
ccgaugccugcugcgcccugc

SEQ ID NO: 1375833 - RNA, 21 nt, Human
ccuagacaaggacaaugagga

SEQ ID NO: 1375834 - RNA, 24 nt, Human
ccugaaguuagcugacaaugggcu

SEQ ID NO: 1375835 - RNA, 18 nt, Human
ccugcggacccucugccc

SEQ ID NO: 1375836 - RNA, 20 nt, Human
ccuggagcacaccugcaguu

SEQ ID NO: 1375837 - RNA, 21 nt, Human
ccuggcaucuuccccaaucuu

SEQ ID NO: 1375838 - RNA, 19 nt, Human
cggccccgccugcggaccc

SEQ ID NO: 1375839 - RNA, 19 nt, Human
cucacccuacuccaccugc

SEQ ID NO: 1375840 - RNA, 22 nt, Human
cucacccuacuccaccugcuca

SEQ ID NO: 1375841 - RNA, 23 nt, Human
cuccugcacccuggagucacgcc

SEQ ID NO: 1375842 - RNA, 18 nt, Human
cugcccuuugucuugccc

SEQ ID NO: 1375843 - RNA, 19 nt, Human
cuggcaucuuccccaaucu

SEQ ID NO: 1375844 - RNA, 22 nt, Human
cuucaccagcaccaggccuacc

SEQ ID NO: 1375845 - RNA, 18 nt, Human
gccucugggacugggucc

SEQ ID NO: 1375846 - RNA, 21 nt, Human
ggagcucacccuacuccaccu

SEQ ID NO: 1375847 - RNA, 23 nt, Human
ggcaggagccuuugcaggggugc

SEQ ID NO: 1375848 - RNA, 21 nt, Human
ggcuggccucugggacugggu

SEQ ID NO: 1375849 - RNA, 23 nt, Human
gggugcacguggaguccccgcgg

SEQ ID NO: 1375850 - RNA, 19 nt, Human
ucagcccaggcuccugcac

SEQ ID NO: 1375851 - RNA, 18 nt, Human
uccagauuggaugcuguc

SEQ ID NO: 1375852 - RNA, 20 nt, Human
uccauuggcagaagugaggc

SEQ ID NO: 1375853 - RNA, 21 nt, Human
uccccuggcgcugcgaacccc

SEQ ID NO: 1375854 - RNA, 21 nt, Human
uccucuggaagcccuggucac

SEQ ID NO: 1375855 - RNA, 18 nt, Human
ucucugaaggagguguug

SEQ ID NO: 1375856 - RNA, 23 nt, Human
ucugggacugggucguaggccuu

SEQ ID NO: 1375857 - RNA, 19 nt, Human
ugaaauaagccuuugcucc

SEQ ID NO: 1375858 - RNA, 18 nt, Human
ugaggagggggugcacgu

SEQ ID NO: 1375859 - RNA, 20 nt, Human
ugaggagggggugcacgugg

SEQ ID NO: 1375860 - RNA, 25 nt, Human
ugaggcuuucaaaacuaguaguuuu

SEQ ID NO: 1375861 - RNA, 25 nt, Human
ugcacucggccccgccugcggaccc

SEQ ID NO: 1375862 - RNA, 20 nt, Human
ugcacugccugcacucggga

SEQ ID NO: 1375863 - RNA, 21 nt, Human
ugcccuuugucuugcccaugg

SEQ ID NO: 1375864 - RNA, 21 nt, Human
ugcguuggcgacaugcuggaa

SEQ ID NO: 1375865 - RNA, 25 nt, Human
ugcucagcccaggcuccugcacccu

SEQ ID NO: 1375866 - RNA, 24 nt, Human
ugcugcagugaggggagcaagcac

SEQ ID NO: 1375867 - RNA, 19 nt, Human
ugcuggagaugcgggaugc

SEQ ID NO: 1375868 - RNA, 19 nt, Human
ugcuggguccccuggcgcu

SEQ ID NO: 1375869 - RNA, 25 nt, Human
uggaaaguggauugcguuggcgaca

SEQ ID NO: 1375870 - RNA, 24 nt, Human
uggaaugugcuuccauuggcagaa

SEQ ID NO: 1375871 - RNA, 19 nt, Human
uggagccagggagcuucuc

SEQ ID NO: 1375872 - RNA, 18 nt, Human
uggcaucuuccccaaucu

SEQ ID NO: 1375873 - RNA, 20 nt, Human
uggcggagcucacccuacuc

SEQ ID NO: 1375874 - RNA, 18 nt, Human
ugggagcuugggggaggg

SEQ ID NO: 1375875 - RNA, 23 nt, Human
ugggcuggccucugggacugggu

SEQ ID NO: 1375876 - RNA, 18 nt, Human
ugucaaaaaaaagaugcc

SEQ ID NO: 1375877 - RNA, 21 nt, Human
uuaaaugcggccuccugugcc

SEQ ID NO: 1375878 - RNA, 21 nt, Human
uuauaagaugucaaaaaaaag

SEQ ID NO: 1375879 - RNA, 18 nt, Human
uugugcacuggccgccac

SEQ ID NO: 1375880 - RNA, 22 nt, Human
aaggacaaugaggagggggugc

SEQ ID NO: 1375881 - RNA, 26 nt, Human
aaugcggccuccugugccgcccuggg

SEQ ID NO: 1375882 - RNA, 21 nt, Human
acccuacuccaccugcucagc

SEQ ID NO: 1375883 - RNA, 22 nt, Human
accuggcaucuuccccaaucuu

SEQ ID NO: 1375884 - RNA, 18 nt, Human
acucggccccgccugcgg

SEQ ID NO: 1375885 - RNA, 18 nt, Human
acugcccgaugccugcug

SEQ ID NO: 1375886 - RNA, 20 nt, Human
agucguuuucauuuuucucu

SEQ ID NO: 1375887 - RNA, 23 nt, Human
caagcacugccuggagccaggga

SEQ ID NO: 1375888 - RNA, 19 nt, Human
caccuggagcacaccugca

SEQ ID NO: 1375889 - RNA, 24 nt, Human
cacuucaccagcgccaggccuacc

SEQ ID NO: 1375890 - RNA, 23 nt, Human
caggccuacccgcgaugcuggcu

SEQ ID NO: 1375891 - RNA, 23 nt, Human
cauuuuucucuagcaacugggaa

SEQ ID NO: 1375892 - RNA, 26 nt, Human
ccaccuggagcacaccugcaguucgc

SEQ ID NO: 1375893 - RNA, 22 nt, Human
ccccgccugcggacccucugcc

SEQ ID NO: 1375894 - RNA, 20 nt, Human
ccccggagccaugccauggg

SEQ ID NO: 1375895 - RNA, 22 nt, Human
cccgccugcggacccucugccc

SEQ ID NO: 1375896 - RNA, 21 nt, Human
ccgaugccugcugcgcccugc

SEQ ID NO: 1375897 - RNA, 21 nt, Human
ccuagacaaggacaaugagga

SEQ ID NO: 1375898 - RNA, 24 nt, Human
ccugaaguuagcugacaaugggcu

SEQ ID NO: 1375899 - RNA, 18 nt, Human
ccugcggacccucugccc

SEQ ID NO: 1375900 - RNA, 18 nt, Human
ccuggagcacaccugcag

SEQ ID NO: 1375901 - RNA, 19 nt, Human
cggccccgccugcggaccc

SEQ ID NO: 1375902 - RNA, 19 nt, Human
cucacccuacuccaccugc

SEQ ID NO: 1375903 - RNA, 22 nt, Human
cucacccuacuccaccugcuca

SEQ ID NO: 1375904 - RNA, 18 nt, Human
cugcccuuugucuugccc

SEQ ID NO: 1375905 - RNA, 19 nt, Human
cuggcaucuuccccaaucu

SEQ ID NO: 1375906 - RNA, 22 nt, Human
cuucaccagcgccaggccuacc

SEQ ID NO: 1375907 - RNA, 23 nt, Human
gaaaguggauugcguuggcgaca

SEQ ID NO: 1375908 - RNA, 18 nt, Human
gcccggggccucagcugg

SEQ ID NO: 1375909 - RNA, 18 nt, Human
gccucugggacugggucc

SEQ ID NO: 1375910 - RNA, 21 nt, Human
ggagcucacccuacuccaccu

SEQ ID NO: 1375911 - RNA, 23 nt, Human
ggcaggagccuuugcaggggugc

SEQ ID NO: 1375912 - RNA, 24 nt, Human
ggcgacaugcuugaaugugcuucc

SEQ ID NO: 1375913 - RNA, 21 nt, Human
ggcuggccucugggacugggu

SEQ ID NO: 1375914 - RNA, 23 nt, Human
gggugcacguggagucuccgcgg

SEQ ID NO: 1375915 - RNA, 24 nt, Human
uaaaaucuuugagaugauugacac

SEQ ID NO: 1375916 - RNA, 20 nt, Human
uacccgcgaugcuggcugga

SEQ ID NO: 1375917 - RNA, 18 nt, Human
ucacuggguucuuggcgg

SEQ ID NO: 1375918 - RNA, 18 nt, Human
uccagauuggaugcuguc

SEQ ID NO: 1375919 - RNA, 21 nt, Human
uccccuggcgcugcgaacccc

SEQ ID NO: 1375920 - RNA, 21 nt, Human
uccucuggaagcccuggucac

SEQ ID NO: 1375921 - RNA, 18 nt, Human
ucucugaaggagguguug

SEQ ID NO: 1375922 - RNA, 23 nt, Human
ucugggacugggucaugggccuu

SEQ ID NO: 1375923 - RNA, 19 nt, Human
ugaaauaagccuuugcucc

SEQ ID NO: 1375924 - RNA, 18 nt, Human
ugaggagggggugcacgu

SEQ ID NO: 1375925 - RNA, 20 nt, Human
ugaggagggggugcacgugg

SEQ ID NO: 1375926 - RNA, 25 nt, Human
ugcacucggccccgccugcggaccc

SEQ ID NO: 1375927 - RNA, 20 nt, Human
ugcacugccugcacucggga

SEQ ID NO: 1375928 - RNA, 20 nt, Human
ugccauaaaaucuuugagau

SEQ ID NO: 1375929 - RNA, 21 nt, Human
ugcccuuugucuugcccaugg

SEQ ID NO: 1375930 - RNA, 27 nt, Human
ugcucagcccaggcuccugugcccccc

SEQ ID NO: 1375931 - RNA, 24 nt, Human
ugcugcagugaggggagcaagcac

SEQ ID NO: 1375932 - RNA, 19 nt, Human
ugcuggguccccuggcgcu

SEQ ID NO: 1375933 - RNA, 19 nt, Human
uggagccagggagcuucuc

SEQ ID NO: 1375934 - RNA, 18 nt, Human
uggcaucuuccccaaucu

SEQ ID NO: 1375935 - RNA, 20 nt, Human
uggcggagcucacccuacuc

SEQ ID NO: 1375936 - RNA, 18 nt, Human
ugggagcuugggggaggg

SEQ ID NO: 1375937 - RNA, 23 nt, Human
ugggcuggccucugggacugggu

SEQ ID NO: 1375938 - RNA, 18 nt, Human
ugggucaugggccuugug

SEQ ID NO: 1375939 - RNA, 18 nt, Human
ugucaaaaagaagaugcc

SEQ ID NO: 1375940 - RNA, 21 nt, Human
uuaaaugcggccuccugugcc

SEQ ID NO: 1375941 - RNA, 21 nt, Human
uuauaagaugucaaaaagaag

SEQ ID NO: 1375942 - RNA, 21 nt, Human
uugggcuuguauugggagcuu

SEQ ID NO: 1375943 - RNA, 18 nt, Human
uugugcacuggccgccac

SEQ ID NO: 1375944 - RNA, 24 nt, Human
aagaaagccauuuugaaaaaagcc

SEQ ID NO: 1375945 - RNA, 25 nt, Human
aagaugccaaggcuaaauacagaua

SEQ ID NO: 1375946 - RNA, 22 nt, Human
agugaccaaaugcaaacauacc

SEQ ID NO: 1375947 - RNA, 23 nt, Human
auggcuuuauuugcugauugaga

SEQ ID NO: 1375948 - RNA, 23 nt, Human
caagaccagaugauugucacuag

SEQ ID NO: 1375949 - RNA, 22 nt, Human
cacugcauagucccuacccuuc

SEQ ID NO: 1375950 - RNA, 22 nt, Human
cagcccaaagcugaaacgucaa

SEQ ID NO: 1375951 - RNA, 20 nt, Human
cauagucccuacccuucugg

SEQ ID NO: 1375952 - RNA, 18 nt, Human
ccuucuggauuaaaugaa

SEQ ID NO: 1375953 - RNA, 22 nt, Human
gagauagcaaaauagacauggc

SEQ ID NO: 1375954 - RNA, 21 nt, Human
gccauuuugaaaaaagccacu

SEQ ID NO: 1375955 - RNA, 24 nt, Human
guccaugacauacccuuuugacag

SEQ ID NO: 1375956 - RNA, 21 nt, Human
gugaccaaaugcaaacauacc

SEQ ID NO: 1375957 - RNA, 20 nt, Human
uaagacaaauauaaagaugc

SEQ ID NO: 1375958 - RNA, 22 nt, Human
uacccuuuugacagcccaaagc

SEQ ID NO: 1375959 - RNA, 20 nt, Human
uacuaacagugcuuuggucc

SEQ ID NO: 1375960 - RNA, 26 nt, Human
uagacauggcuuuauuugcugauuga

SEQ ID NO: 1375961 - RNA, 21 nt, Human
uaggaagaaagcagaagugau

SEQ ID NO: 1375962 - RNA, 21 nt, Human
ugauugagaagugguccagcc

SEQ ID NO: 1375963 - RNA, 19 nt, Human
ugcauagucccuacccuuc

SEQ ID NO: 1375964 - RNA, 22 nt, Human
ugcauagucccuacccuucugg

SEQ ID NO: 1375965 - RNA, 18 nt, Human
ugccaaggcuaaauacag

SEQ ID NO: 1375966 - RNA, 24 nt, Human
uucaaaauaagacaaauauaaaga

SEQ ID NO: 1375967 - RNA, 24 nt, Human
aaagcagacgauaagaagcaggga

SEQ ID NO: 1375968 - RNA, 19 nt, Human
aacuuuccccgcuggcacc

SEQ ID NO: 1375969 - RNA, 20 nt, Human
aagaagcagggaaacuuucc

SEQ ID NO: 1375970 - RNA, 22 nt, Human
aagcagacgauaagaagcaggg

SEQ ID NO: 1375971 - RNA, 26 nt, Human
aagcagacgauaagaagcagggaaac

SEQ ID NO: 1375972 - RNA, 20 nt, Human
cacaaaguuccugcagccag

SEQ ID NO: 1375973 - RNA, 18 nt, Human
cccgccuuucccgagggc

SEQ ID NO: 1375974 - RNA, 24 nt, Human
ccgcuggcaccuagcuugcagacc

SEQ ID NO: 1375975 - RNA, 22 nt, Human
ccuccccaccccgccuuucccg

SEQ ID NO: 1375976 - RNA, 19 nt, Human
ccucuuuauuuuuucugcc

SEQ ID NO: 1375977 - RNA, 20 nt, Human
cuggcaccuagcuugcagac

SEQ ID NO: 1375978 - RNA, 23 nt, Human
gaacauggacagcuuuuccaugc

SEQ ID NO: 1375979 - RNA, 19 nt, Human
gacgauaagaagcagggaa

SEQ ID NO: 1375980 - RNA, 23 nt, Human
gauaagaagcagggaaacuuucc

SEQ ID NO: 1375981 - RNA, 22 nt, Human
gcccugggcucaaggucacucg

SEQ ID NO: 1375982 - RNA, 22 nt, Human
gucgaggaggcuaagcugcucu

SEQ ID NO: 1375983 - RNA, 26 nt, Human
guuaaagcagacgauaagaagcaggg

SEQ ID NO: 1375984 - RNA, 27 nt, Human
guuaaagcagacgauaagaagcaggga

SEQ ID NO: 1375985 - RNA, 20 nt, Human
uaaagcagacgauaagaagc

SEQ ID NO: 1375986 - RNA, 23 nt, Human
uaaagcagacgauaagaagcagg

SEQ ID NO: 1375987 - RNA, 20 nt, Human
uaagcugcucucgccucccc

SEQ ID NO: 1375988 - RNA, 21 nt, Human
uaagcugcucucgccucccca

SEQ ID NO: 1375989 - RNA, 21 nt, Human
uaggagucauuaaguauaugg

SEQ ID NO: 1375990 - RNA, 20 nt, Human
ucaaggucacucggugaagc

SEQ ID NO: 1375991 - RNA, 20 nt, Human
uccgucaccaggaagggagg

SEQ ID NO: 1375992 - RNA, 19 nt, Human
ugcuauuacacugagacuu

SEQ ID NO: 1375993 - RNA, 20 nt, Human
uuccccgcuggcaccuagcu

SEQ ID NO: 1375994 - RNA, 20 nt, Human
uugguccugcuauuacacug

SEQ ID NO: 1375995 - RNA, 18 nt, Human
agaauguuagaaucuauu

SEQ ID NO: 1375996 - RNA, 23 nt, Human
aggaaaaacgacgacgaacaaaa

SEQ ID NO: 1375997 - RNA, 18 nt, Human
gaaggaaaaacgacgacg

SEQ ID NO: 1375998 - RNA, 21 nt, Human
ggaaaaacgacgacgaacaaa

SEQ ID NO: 1375999 - RNA, 20 nt, Human
guagcucaaacaucucaagu

SEQ ID NO: 1376000 - RNA, 20 nt, Human
uaggucugauaaaacugguu

SEQ ID NO: 1376001 - RNA, 19 nt, Human
uaugaaggaaaaacgacga

SEQ ID NO: 1376002 - RNA, 21 nt, Human
ucuauccaugaaaacagaauc

SEQ ID NO: 1376003 - RNA, 21 nt, Human
ugaaaacagaaucaauuaaac

SEQ ID NO: 1376004 - RNA, 23 nt, Human
ugaaaacagaaucaauuaaacau

SEQ ID NO: 1376005 - RNA, 22 nt, Human
ugcuuggaagacuuaguugaau

SEQ ID NO: 1376006 - RNA, 20 nt, Human
uuccagugcugcauaacuag

SEQ ID NO: 1376007 - RNA, 23 nt, Human
aaaaacaugaaucuccuucaaga

SEQ ID NO: 1376008 - RNA, 21 nt, Human
aaacaagccaaucacaucgaa

SEQ ID NO: 1376009 - RNA, 22 nt, Human
aaacaagccaaucacaucgaau

SEQ ID NO: 1376010 - RNA, 24 nt, Human
aaacuucugacauguaaacauacu

SEQ ID NO: 1376011 - RNA, 20 nt, Human
aacaaaacuucugacaugua

SEQ ID NO: 1376012 - RNA, 27 nt, Human
aacucuguacauguucacaaauuauug

SEQ ID NO: 1376013 - RNA, 24 nt, Human
aagcuggaaaaaaguaauugcuag

SEQ ID NO: 1376014 - RNA, 22 nt, Human
aauugcuagggaagggaaaaau

SEQ ID NO: 1376015 - RNA, 20 nt, Human
acgccggggcgcggagacgg

SEQ ID NO: 1376016 - RNA, 19 nt, Human
acucuguacauguucacaa

SEQ ID NO: 1376017 - RNA, 18 nt, Human
agacccgggaggcgggag

SEQ ID NO: 1376018 - RNA, 25 nt, Human
aggcaguaaaaaaauguauuccuga

SEQ ID NO: 1376019 - RNA, 20 nt, Human
agguuccccgcugucagccu

SEQ ID NO: 1376020 - RNA, 24 nt, Human
agguuccccgcugucagccucacu

SEQ ID NO: 1376021 - RNA, 24 nt, Human
aguggaauagucgagggaagcgag

SEQ ID NO: 1376022 - RNA, 22 nt, Human
aguguacauggcugagcaugca

SEQ ID NO: 1376023 - RNA, 23 nt, Human
auaaaacaaauacauauaguuca

SEQ ID NO: 1376024 - RNA, 20 nt, Human
auaguuacaaagauaccugc

SEQ ID NO: 1376025 - RNA, 22 nt, Human
augagauagggcacaaucuguu

SEQ ID NO: 1376026 - RNA, 23 nt, Human
auuacaauagaauuacacagugc

SEQ ID NO: 1376027 - RNA, 22 nt, Human
caaaaauaacuucauaagccau

SEQ ID NO: 1376028 - RNA, 23 nt, Human
caaaacuucugacauguaaacau

SEQ ID NO: 1376029 - RNA, 23 nt, Human
caacgcaauacuguugaaccaca

SEQ ID NO: 1376030 - RNA, 20 nt, Human
cagcauaaucuucaagacaa

SEQ ID NO: 1376031 - RNA, 26 nt, Human
caguuuuguuuuaaaaauugguuuaa

SEQ ID NO: 1376032 - RNA, 19 nt, Human
cauacugccauguuccuga

SEQ ID NO: 1376033 - RNA, 24 nt, Human
cauagaauuaaacaaaacuucuga

SEQ ID NO: 1376034 - RNA, 21 nt, Human
ccaccgcggggagggcggagg

SEQ ID NO: 1376035 - RNA, 22 nt, Human
ccagucuucagcaaaacuaaaa

SEQ ID NO: 1376036 - RNA, 20 nt, Human
ccccgcugucagccucacuc

SEQ ID NO: 1376037 - RNA, 18 nt, Human
ccgcuguccucccucggc

SEQ ID NO: 1376038 - RNA, 20 nt, Human
ccucacuccgccgccgccag

SEQ ID NO: 1376039 - RNA, 21 nt, Human
cgccacauaaaaacaagccaa

SEQ ID NO: 1376040 - RNA, 25 nt, Human
cgccaggccccgcuguccucccucg

SEQ ID NO: 1376041 - RNA, 18 nt, Human
gcauaaacagcauaaucu

SEQ ID NO: 1376042 - RNA, 21 nt, Human
gccagucuucagcaaaacuaa

SEQ ID NO: 1376043 - RNA, 21 nt, Human
gcuuuuuuuucuuuaucacaa

SEQ ID NO: 1376044 - RNA, 20 nt, Human
ggccccgcuguccucccucg

SEQ ID NO: 1376045 - RNA, 23 nt, Human
gggagggagugucuccaguggcg

SEQ ID NO: 1376046 - RNA, 19 nt, Human
gucgagggaagcgaggaag

SEQ ID NO: 1376047 - RNA, 18 nt, Human
uaagaagaguugaagcug

SEQ ID NO: 1376048 - RNA, 19 nt, Human
uaaucuguaggcaacccuc

SEQ ID NO: 1376049 - RNA, 18 nt, Human
uaauugcuagggaaggga

SEQ ID NO: 1376050 - RNA, 18 nt, Human
uacacagugccugaaaau

SEQ ID NO: 1376051 - RNA, 20 nt, Human
uacagcuguuaaacagguuc

SEQ ID NO: 1376052 - RNA, 24 nt, Human
uaccauagaauuaaacaaaacuuc

SEQ ID NO: 1376053 - RNA, 21 nt, Human
uaggaaagcuguccauuaaua

SEQ ID NO: 1376054 - RNA, 22 nt, Human
uaucaaaaauaacuucauaagc

SEQ ID NO: 1376055 - RNA, 20 nt, Human
uaucacaauucacuaaguga

SEQ ID NO: 1376056 - RNA, 24 nt, Human
uauucugcugaccucuuaauuuca

SEQ ID NO: 1376057 - RNA, 18 nt, Human
ucaaagcacuuugauuua

SEQ ID NO: 1376058 - RNA, 20 nt, Human
ucaaagcacuuugauuuaag

SEQ ID NO: 1376059 - RNA, 22 nt, Human
ucggcggaacaauggcggcuuu

SEQ ID NO: 1376060 - RNA, 23 nt, Human
ucucggcgccagcgccaggcccc

SEQ ID NO: 1376061 - RNA, 21 nt, Human
ucugugcauaagauccaagga

SEQ ID NO: 1376062 - RNA, 21 nt, Human
ugaaucuccuucaagaaauug

SEQ ID NO: 1376063 - RNA, 19 nt, Human
ugacauguaaacauacugc

SEQ ID NO: 1376064 - RNA, 21 nt, Human
ugacauguaaacauacugcca

SEQ ID NO: 1376065 - RNA, 18 nt, Human
ugagauagggcacaaucu

SEQ ID NO: 1376066 - RNA, 18 nt, Human
ugauaaaaguuaauaauc

SEQ ID NO: 1376067 - RNA, 24 nt, Human
ugcaaacacauguccaauucagga

SEQ ID NO: 1376068 - RNA, 23 nt, Human
ugcuaccaacaaauauguaaaga

SEQ ID NO: 1376069 - RNA, 21 nt, Human
ugcuagggaagggaaaaaugu

SEQ ID NO: 1376070 - RNA, 21 nt, Human
uggauggauagaucaguacca

SEQ ID NO: 1376071 - RNA, 21 nt, Human
ugguaaaggcuauuuacagug

SEQ ID NO: 1376072 - RNA, 19 nt, Human
ugguacaaguucugugcau

SEQ ID NO: 1376073 - RNA, 24 nt, Human
uguaaagauauggcagguuaugca

SEQ ID NO: 1376074 - RNA, 24 nt, Human
uugaucaaagcacuuugauuuaag

SEQ ID NO: 1376075 - RNA, 30 nt, Human
aaaaaaaaaaaacagaacauagaucaaggg

SEQ ID NO: 1376076 - RNA, 29 nt, Human
aaaaaaaaaacagaacauagagggacccc

SEQ ID NO: 1376077 - RNA, 24 nt, Human
aaaaaaaacagaacauagaucaag

SEQ ID NO: 1376078 - RNA, 21 nt, Human
aaaaaaacagaacauagauca

SEQ ID NO: 1376079 - RNA, 22 nt, Human
aaaaaaacagaacauagaucaa

SEQ ID NO: 1376080 - RNA, 23 nt, Human
aaaaaaacagaacauagaucaag

SEQ ID NO: 1376081 - RNA, 19 nt, Human
aaacagaacauagaucaag

SEQ ID NO: 1376082 - RNA, 25 nt, Human
aaacauuuccaccaaccucaaaccc

SEQ ID NO: 1376083 - RNA, 22 nt, Human
aaaccccgucucuccuaaaaaa

SEQ ID NO: 1376084 - RNA, 19 nt, Human
aacacggugaaaccccguc

SEQ ID NO: 1376085 - RNA, 20 nt, Human
aacacggugaaaccccgucu

SEQ ID NO: 1376086 - RNA, 21 nt, Human
aacacggugaaaccccgucuc

SEQ ID NO: 1376087 - RNA, 21 nt, Human
aagcaagauccagugguugug

SEQ ID NO: 1376088 - RNA, 20 nt, Human
accaacaagaauacacauaa

SEQ ID NO: 1376089 - RNA, 24 nt, Human
acccagcccauauacaacuauuuc

SEQ ID NO: 1376090 - RNA, 18 nt, Human
accccgucucuccuaaaa

SEQ ID NO: 1376091 - RNA, 19 nt, Human
acccuggaaacagagugag

SEQ ID NO: 1376092 - RNA, 19 nt, Human
acugcacucuagccugggc

SEQ ID NO: 1376093 - RNA, 24 nt, Human
acugcacucuagccugggcggcag

SEQ ID NO: 1376094 - RNA, 22 nt, Human
agaagaggaaucagagcucagg

SEQ ID NO: 1376095 - RNA, 19 nt, Human
agacagaagaggaaucaga

SEQ ID NO: 1376096 - RNA, 18 nt, Human
agacagagaccauggggg

SEQ ID NO: 1376097 - RNA, 24 nt, Human
agaggucgugccacugcacucuag

SEQ ID NO: 1376098 - RNA, 21 nt, Human
agcaaacuggacaggaagggg

SEQ ID NO: 1376099 - RNA, 24 nt, Human
agcacuuugagaggcugaggcggg

SEQ ID NO: 1376100 - RNA, 22 nt, Human
agcaguauagaaaccacucccc

SEQ ID NO: 1376101 - RNA, 24 nt, Human
agccugggcggcagggcgagacuc

SEQ ID NO: 1376102 - RNA, 20 nt, Human
agcugggcaugguggugggc

SEQ ID NO: 1376103 - RNA, 26 nt, Human
aggaagggguggguggggcugggggg

SEQ ID NO: 1376104 - RNA, 24 nt, Human
aggcaggaaauggcgucaacccag

SEQ ID NO: 1376105 - RNA, 19 nt, Human
aggcaggcaugaaaaucag

SEQ ID NO: 1376106 - RNA, 24 nt, Human
aggcaggcaugaaaaucagccaga

SEQ ID NO: 1376107 - RNA, 21 nt, Human
aggccgaggcaggaaauggcg

SEQ ID NO: 1376108 - RNA, 19 nt, Human
aggcgggaggaucacaagg

SEQ ID NO: 1376109 - RNA, 24 nt, Human
aggcgggaggaucacaaggucagg

SEQ ID NO: 1376110 - RNA, 19 nt, Human
aggcugaggcgggaggauc

SEQ ID NO: 1376111 - RNA, 20 nt, Human
aggcugggugcgguggcuca

SEQ ID NO: 1376112 - RNA, 23 nt, Human
aggggcacagcugacaaucacca

SEQ ID NO: 1376113 - RNA, 21 nt, Human
agggguggguggggcuggggg

SEQ ID NO: 1376114 - RNA, 20 nt, Human
agguugcuucuuugaggcac

SEQ ID NO: 1376115 - RNA, 22 nt, Human
aguacuggguguguagagguug

SEQ ID NO: 1376116 - RNA, 22 nt, Human
caaaaaggagagaggagcccca

SEQ ID NO: 1376117 - RNA, 25 nt, Human
caaacuggacaggaaggggugggug

SEQ ID NO: 1376118 - RNA, 22 nt, Human
caaccucaaaccccauggcccu

SEQ ID NO: 1376119 - RNA, 24 nt, Human
cacaccuguaaucccagcacuuug

SEQ ID NO: 1376120 - RNA, 18 nt, Human
cacauaaucaucacuaau

SEQ ID NO: 1376121 - RNA, 23 nt, Human
caccaaauggaaaccaaaaccca

SEQ ID NO: 1376122 - RNA, 18 nt, Human
caccuguaaucccagcac

SEQ ID NO: 1376123 - RNA, 23 nt, Human
caccuguaaucccagcacuuuga

SEQ ID NO: 1376124 - RNA, 19 nt, Human
caccuguagucccagcuac

SEQ ID NO: 1376125 - RNA, 23 nt, Human
caccuguagucccagcuacucca

SEQ ID NO: 1376126 - RNA, 19 nt, Human
cacugcacucuagccuggg

SEQ ID NO: 1376127 - RNA, 20 nt, Human
cacugcacucuagccugggc

SEQ ID NO: 1376128 - RNA, 21 nt, Human
cacugcacucuagccugggcg

SEQ ID NO: 1376129 - RNA, 24 nt, Human
cacugcacucuagccugggcggca

SEQ ID NO: 1376130 - RNA, 24 nt, Human
cagaaacacucauuccacaccaaa

SEQ ID NO: 1376131 - RNA, 26 nt, Human
cagaacauagaucaagguucauguaa

SEQ ID NO: 1376132 - RNA, 24 nt, Human
cagcacuuugagaggcugaggcgg

SEQ ID NO: 1376133 - RNA, 24 nt, Human
cagcuacuccagaggccgaggcag

SEQ ID NO: 1376134 - RNA, 23 nt, Human
caggaagggguggguggggcugg

SEQ ID NO: 1376135 - RNA, 22 nt, Human
cauauacaacuauuucagaaca

SEQ ID NO: 1376136 - RNA, 24 nt, Human
ccacaccaaauggaaaccaaaacc

SEQ ID NO: 1376137 - RNA, 20 nt, Human
ccacugcacucuagccuggg

SEQ ID NO: 1376138 - RNA, 20 nt, Human
ccacugcacucuagccuggg

SEQ ID NO: 1376139 - RNA, 21 nt, Human
ccacugcacucuagccugggc

SEQ ID NO: 1376140 - RNA, 21 nt, Human
ccacugcacucuagccugggc

SEQ ID NO: 1376141 - RNA, 22 nt, Human
ccacugcacucuagccugggcg

SEQ ID NO: 1376142 - RNA, 22 nt, Human
ccacugcacucuagccugggcg

SEQ ID NO: 1376143 - RNA, 23 nt, Human
ccacugcacucuagccugggcgg

SEQ ID NO: 1376144 - RNA, 24 nt, Human
ccacugcacucuagccugggcggc

SEQ ID NO: 1376145 - RNA, 21 nt, Human
ccagacagaagaggaaucaga

SEQ ID NO: 1376146 - RNA, 22 nt, Human
cccacaguucagaaacacucau

SEQ ID NO: 1376147 - RNA, 19 nt, Human
ccucaaaccccauggcccu

SEQ ID NO: 1376148 - RNA, 28 nt, Human
ccucacuguggggcaugggggcgaggac

SEQ ID NO: 1376149 - RNA, 19 nt, Human
ccucuacccuggaaacaga

SEQ ID NO: 1376150 - RNA, 23 nt, Human
ccugacuaacacggugaaacccc

SEQ ID NO: 1376151 - RNA, 24 nt, Human
ccugacuaacacggugaaaccccg

SEQ ID NO: 1376152 - RNA, 22 nt, Human
ccugggcggcagggcgagacuc

SEQ ID NO: 1376153 - RNA, 22 nt, Human
ccuguagucccagcuacuccag

SEQ ID NO: 1376154 - RNA, 23 nt, Human
ccuguagucccagcuacuccaga

SEQ ID NO: 1376155 - RNA, 24 nt, Human
cgagaccauccugacuaacacggu

SEQ ID NO: 1376156 - RNA, 24 nt, Human
cgaggcaggaaauggcgucaaccc

SEQ ID NO: 1376157 - RNA, 22 nt, Human
cucacaccuguaaucccagcac

SEQ ID NO: 1376158 - RNA, 24 nt, Human
cucacaccuguaaucccagcacuu

SEQ ID NO: 1376159 - RNA, 19 nt, Human
cucaggauauagauugaga

SEQ ID NO: 1376160 - RNA, 22 nt, Human
cucagucaaaaaaaaaaaaaaa

SEQ ID NO: 1376161 - RNA, 22 nt, Human
cucauuccacaccaaauggaaa

SEQ ID NO: 1376162 - RNA, 23 nt, Human
cucauuccacaccaaauggaaac

SEQ ID NO: 1376163 - RNA, 22 nt, Human
cucugacuuuugggcagccccc

SEQ ID NO: 1376164 - RNA, 18 nt, Human
cugacuaacacggugaaa

SEQ ID NO: 1376165 - RNA, 19 nt, Human
cugcaugcuuaucucaccc

SEQ ID NO: 1376166 - RNA, 22 nt, Human
cuggaccccugagcacuuggga

SEQ ID NO: 1376167 - RNA, 21 nt, Human
gaaacacucauuccacaccaa

SEQ ID NO: 1376168 - RNA, 21 nt, Human
gaaaccaaaacccaguacugg

SEQ ID NO: 1376169 - RNA, 22 nt, Human
gacaggaagggguggguggggc

SEQ ID NO: 1376170 - RNA, 19 nt, Human
gaccccugagcacuuggga

SEQ ID NO: 1376171 - RNA, 21 nt, Human
gcaaggcaggcaugaaaauca

SEQ ID NO: 1376172 - RNA, 24 nt, Human
gccacugcacucuagccugggcgg

SEQ ID NO: 1376173 - RNA, 24 nt, Human
gccucucacccacaguucagaaac

SEQ ID NO: 1376174 - RNA, 20 nt, Human
gcgguggcucacaccuguaa

SEQ ID NO: 1376175 - RNA, 21 nt, Human
ggaagggguggguggggcugg

SEQ ID NO: 1376176 - RNA, 19 nt, Human
ggacaggaaggggugggug

SEQ ID NO: 1376177 - RNA, 20 nt, Human
ggacaggaaggggugggugg

SEQ ID NO: 1376178 - RNA, 18 nt, Human
ggaggaucacaaggucag

SEQ ID NO: 1376179 - RNA, 22 nt, Human
ggcaugguggugggcaccugua

SEQ ID NO: 1376180 - RNA, 21 nt, Human
ggcucacaccuguaaucccag

SEQ ID NO: 1376181 - RNA, 20 nt, Human
gggcaccuguagucccagcu

SEQ ID NO: 1376182 - RNA, 18 nt, Human
gggcuggggggagcugag

SEQ ID NO: 1376183 - RNA, 18 nt, Human
ggguggggcuggggggag

SEQ ID NO: 1376184 - RNA, 19 nt, Human
ggguggggcuggggggagc

SEQ ID NO: 1376185 - RNA, 21 nt, Human
ggguggguggggcugggggga

SEQ ID NO: 1376186 - RNA, 18 nt, Human
ggucaggggcacagcuga

SEQ ID NO: 1376187 - RNA, 23 nt, Human
gguggcucacaccuguaauccca

SEQ ID NO: 1376188 - RNA, 24 nt, Human
gguggcucacaccuguaaucccag

SEQ ID NO: 1376189 - RNA, 24 nt, Human
gguggugggcaccuguagucccag

SEQ ID NO: 1376190 - RNA, 18 nt, Human
gguugugggggcaaggga

SEQ ID NO: 1376191 - RNA, 21 nt, Human
gucaaaaaaaaaaaaaaaaaa

SEQ ID NO: 1376192 - RNA, 24 nt, Human
gucgugccacugcacucuagccug

SEQ ID NO: 1376193 - RNA, 18 nt, Human
gugguuguuccucaaauc

SEQ ID NO: 1376194 - RNA, 18 nt, Human
uaacacggugaaaccccg

SEQ ID NO: 1376195 - RNA, 22 nt, Human
uaacacggugaaaccccgucuc

SEQ ID NO: 1376196 - RNA, 24 nt, Human
uaacacggugaaaccccgucucuc

SEQ ID NO: 1376197 - RNA, 25 nt, Human
uagaaaaaauuagcugggcauggug

SEQ ID NO: 1376198 - RNA, 22 nt, Human
uagagacagagaccauggggga

SEQ ID NO: 1376199 - RNA, 22 nt, Human
uagcucugaguuucacuuuccc

SEQ ID NO: 1376200 - RNA, 23 nt, Human
uaggcugggugcgguggcucaca

SEQ ID NO: 1376201 - RNA, 22 nt, Human
uauaucauuccuccuauccaug

SEQ ID NO: 1376202 - RNA, 21 nt, Human
ucaacccaguaggcagaccuu

SEQ ID NO: 1376203 - RNA, 18 nt, Human
ucacaaggucaggagauc

SEQ ID NO: 1376204 - RNA, 24 nt, Human
ucacaaggucaggagaucgagacc

SEQ ID NO: 1376205 - RNA, 25 nt, Human
ucagucaaaaaaaaaaaaaaaaaaa

SEQ ID NO: 1376206 - RNA, 23 nt, Human
ugaaaccccgucucuccuaaaaa

SEQ ID NO: 1376207 - RNA, 19 nt, Human
ugagaaggacuuaguggca

SEQ ID NO: 1376208 - RNA, 20 nt, Human
ugagaggcugaggcgggagg

SEQ ID NO: 1376209 - RNA, 24 nt, Human
ugagaggcugaggcgggaggauca

SEQ ID NO: 1376210 - RNA, 21 nt, Human
ugaggcgggaggaucacaagg

SEQ ID NO: 1376211 - RNA, 24 nt, Human
ugaggcgggaggaucacaagguca

SEQ ID NO: 1376212 - RNA, 21 nt, Human
uggcgucaacccaguaggcag

SEQ ID NO: 1376213 - RNA, 23 nt, Human
uggcgucaacccaguaggcagac

SEQ ID NO: 1376214 - RNA, 21 nt, Human
uggcucacaccuguaauccca

SEQ ID NO: 1376215 - RNA, 22 nt, Human
uggcucacaccuguaaucccag

SEQ ID NO: 1376216 - RNA, 24 nt, Human
uggcucacaccuguaaucccagca

SEQ ID NO: 1376217 - RNA, 24 nt, Human
ugguggugggcaccuguaguccca

SEQ ID NO: 1376218 - RNA, 19 nt, Human
uguaaaauuuucccugucu

SEQ ID NO: 1376219 - RNA, 18 nt, Human
uguguagagguugcuucu

SEQ ID NO: 1376220 - RNA, 24 nt, Human
uuaaaaccguuucuggggacuuac

SEQ ID NO: 1376221 - RNA, 18 nt, Human
uuagcugggcaugguggu

SEQ ID NO: 1376222 - RNA, 24 nt, Human
uuagcugggcaugguggugggcac

SEQ ID NO: 1376223 - RNA, 25 nt, Human
uugagaggcugaggcgggaggauca

SEQ ID NO: 1376224 - RNA, 21 nt, Human
uugcugacucuguguccagcc

SEQ ID NO: 1376225 - RNA, 20 nt, Human
uugcuucuuugaggcaccug

SEQ ID NO: 1376226 - RNA, 19 nt, Human
uuggaggcacauuccucua

SEQ ID NO: 1376227 - RNA, 24 nt, Human
uuucaaaaaggagagaggagcccc

SEQ ID NO: 1376228 - RNA, 23 nt, Human
uuuucccugucuucaaacagggg

SEQ ID NO: 1376229 - RNA, 18 nt, Human
aaugcagcuucguggccu

SEQ ID NO: 1376230 - RNA, 21 nt, Human
agaauuuuuccaaaaucugac

SEQ ID NO: 1376231 - RNA, 18 nt, Human
aggaaggccacagcagcc

SEQ ID NO: 1376232 - RNA, 21 nt, Human
auacuggaaucuucacagugc

SEQ ID NO: 1376233 - RNA, 24 nt, Human
cacggugguccucagcugggaaug

SEQ ID NO: 1376234 - RNA, 20 nt, Human
ccucagcugggaaugcagcu

SEQ ID NO: 1376235 - RNA, 18 nt, Human
gcacggugguccucagcu

SEQ ID NO: 1376236 - RNA, 21 nt, Human
ucagccacuuucuggaaggca

SEQ ID NO: 1376237 - RNA, 20 nt, Human
uccaaaaucugacggaaaga

SEQ ID NO: 1376238 - RNA, 22 nt, Human
uccucccagauaggguaggagc

SEQ ID NO: 1376239 - RNA, 23 nt, Human
ucuucacagugcaucuguuacuu

SEQ ID NO: 1376240 - RNA, 23 nt, Human
uggaaggcauccaggaaggccac

SEQ ID NO: 1376241 - RNA, 18 nt, Human
ugguguggagggggcggg

SEQ ID NO: 1376242 - RNA, 22 nt, Human
uuaauacuggaaucuucacagu

SEQ ID NO: 1376243 - RNA, 21 nt, Human
uuccaaaaucugacggaaaga

SEQ ID NO: 1376244 - RNA, 18 nt, Human
acuccgcucaggcagggg

SEQ ID NO: 1376245 - RNA, 25 nt, Human
acuccgcucaggcaggggugggggc

SEQ ID NO: 1376246 - RNA, 20 nt, Human
agaaauacuagagaagcugc

SEQ ID NO: 1376247 - RNA, 21 nt, Human
agcccucuuuccugccccucc

SEQ ID NO: 1376248 - RNA, 21 nt, Human
aggcaccccccaucccgagga

SEQ ID NO: 1376249 - RNA, 21 nt, Human
aggcaggggugggggcagggc

SEQ ID NO: 1376250 - RNA, 25 nt, Human
aggcaggggugggggcagggcaggu

SEQ ID NO: 1376251 - RNA, 19 nt, Human
caaguccuugggccgaaua

SEQ ID NO: 1376252 - RNA, 22 nt, Human
cacacaaaaaucaccgaaaaua

SEQ ID NO: 1376253 - RNA, 22 nt, Human
cagcacuggguccacugacgcu

SEQ ID NO: 1376254 - RNA, 20 nt, Human
cagccccgccccccagcccc

SEQ ID NO: 1376255 - RNA, 23 nt, Human
cagccccgccccccagccccaga

SEQ ID NO: 1376256 - RNA, 23 nt, Human
cagccccgccccccagccccaga

SEQ ID NO: 1376257 - RNA, 19 nt, Human
cagccucuccccacccccc

SEQ ID NO: 1376258 - RNA, 22 nt, Human
cagccucuccccaccccccuua

SEQ ID NO: 1376259 - RNA, 18 nt, Human
caggcaggggugggggca

SEQ ID NO: 1376260 - RNA, 18 nt, Human
caggcgccuccggggagg

SEQ ID NO: 1376261 - RNA, 19 nt, Human
cagguuccagccuagaugu

SEQ ID NO: 1376262 - RNA, 19 nt, Human
caguccuccccaucaauca

SEQ ID NO: 1376263 - RNA, 21 nt, Human
cauucacgacggagcugaggg

SEQ ID NO: 1376264 - RNA, 26 nt, Human
ccagccccgccccccagccccagaaa

SEQ ID NO: 1376265 - RNA, 23 nt, Human
ccagggucugcgcaguccucccc

SEQ ID NO: 1376266 - RNA, 21 nt, Human
cccagccucuccccacccccc

SEQ ID NO: 1376267 - RNA, 19 nt, Human
cccccagccccagaaauac

SEQ ID NO: 1376268 - RNA, 20 nt, Human
ccccccagccccagaaauac

SEQ ID NO: 1376269 - RNA, 20 nt, Human
ccccgccccccagccccaga

SEQ ID NO: 1376270 - RNA, 18 nt, Human
ccccuccagccccgcccc

SEQ ID NO: 1376271 - RNA, 25 nt, Human
ccccuccagccccgccccccagccc

SEQ ID NO: 1376272 - RNA, 21 nt, Human
cccgccuggaucccgcccgcc

SEQ ID NO: 1376273 - RNA, 18 nt, Human
ccgccccccagccccaga

SEQ ID NO: 1376274 - RNA, 22 nt, Human
ccgggaugugggggcuuuucuc

SEQ ID NO: 1376275 - RNA, 23 nt, Human
ccuccagccccgccccccagccc

SEQ ID NO: 1376276 - RNA, 18 nt, Human
ccuggaaugcggcucuag

SEQ ID NO: 1376277 - RNA, 20 nt, Human
ccuuauagcccucuuuccug

SEQ ID NO: 1376278 - RNA, 19 nt, Human
cgcugcugcucccaagggg

SEQ ID NO: 1376279 - RNA, 19 nt, Human
cuagagaagcugcaccaua

SEQ ID NO: 1376280 - RNA, 21 nt, Human
cucuccccaccccccuuaucc

SEQ ID NO: 1376281 - RNA, 26 nt, Human
cuuauagcccucuuuccugccccucc

SEQ ID NO: 1376282 - RNA, 21 nt, Human
gaccagagcccuggacauucc

SEQ ID NO: 1376283 - RNA, 23 nt, Human
gacuccgcucaggcagggguggg

SEQ ID NO: 1376284 - RNA, 20 nt, Human
gaggagcggaccagagcccu

SEQ ID NO: 1376285 - RNA, 19 nt, Human
gcccagccucuccccaccc

SEQ ID NO: 1376286 - RNA, 20 nt, Human
gccccagaaauacuagagaa

SEQ ID NO: 1376287 - RNA, 22 nt, Human
gccgucaggguuguucuugacu

SEQ ID NO: 1376288 - RNA, 20 nt, Human
ggacuccgcucaggcagggg

SEQ ID NO: 1376289 - RNA, 21 nt, Human
gggggaggugugcagguucca

SEQ ID NO: 1376290 - RNA, 22 nt, Human
uaccaccagccguuagcgaaac

SEQ ID NO: 1376291 - RNA, 18 nt, Human
uaggcaccccccaucccg

SEQ ID NO: 1376292 - RNA, 22 nt, Human
uaggguugggaagaccccucuu

SEQ ID NO: 1376293 - RNA, 20 nt, Human
ucaggauugagauguggguc

SEQ ID NO: 1376294 - RNA, 20 nt, Human
uccccaccccccuuauccuc

SEQ ID NO: 1376295 - RNA, 23 nt, Human
ucccccggcccagccucucccca

SEQ ID NO: 1376296 - RNA, 21 nt, Human
ucgccagggucugcgcagucc

SEQ ID NO: 1376297 - RNA, 18 nt, Human
ucugcgcaguccucccca

SEQ ID NO: 1376298 - RNA, 23 nt, Human
ugaugcguggacacuccuucccc

SEQ ID NO: 1376299 - RNA, 26 nt, Human
ugggccgaauaagagggagggcagcc

SEQ ID NO: 1376300 - RNA, 19 nt, Human
uuaauauucucacacaaaa

SEQ ID NO: 1376301 - RNA, 22 nt, Human
uuagcgaaacaggauuuuuuuu

SEQ ID NO: 1376302 - RNA, 22 nt, Human
uugaugcguggacacuccuucc

SEQ ID NO: 1376303 - RNA, 20 nt, Human
uugcagcccucccgguacuc

SEQ ID NO: 1376304 - RNA, 25 nt, Human
aaacaggcccuuuaacuggagauuu

SEQ ID NO: 1376305 - RNA, 23 nt, Human
aaagguuacagguuauagcuuua

SEQ ID NO: 1376306 - RNA, 19 nt, Human
aacacacaggcccaaggca

SEQ ID NO: 1376307 - RNA, 22 nt, Human
aaccugcucauuucuuagguuu

SEQ ID NO: 1376308 - RNA, 23 nt, Human
aagacacuggaccgaaagccucc

SEQ ID NO: 1376309 - RNA, 19 nt, Human
aagccugguguccacuccc

SEQ ID NO: 1376310 - RNA, 19 nt, Human
acccgccucugagguuccg

SEQ ID NO: 1376311 - RNA, 22 nt, Human
accucacaggccaguaagaaac

SEQ ID NO: 1376312 - RNA, 18 nt, Human
agaaggugcucagaggcc

SEQ ID NO: 1376313 - RNA, 21 nt, Human
agaaggugcucagaggccagg

SEQ ID NO: 1376314 - RNA, 24 nt, Human
agagcacagcacccuagugaccag

SEQ ID NO: 1376315 - RNA, 27 nt, Human
agauuuuaaagguuacagguuauagcu

SEQ ID NO: 1376316 - RNA, 21 nt, Human
agcuggccaggcuguggggcg

SEQ ID NO: 1376317 - RNA, 18 nt, Human
aggcccaaggcacuacgg

SEQ ID NO: 1376318 - RNA, 22 nt, Human
agggcacugaggggcgaagcca

SEQ ID NO: 1376319 - RNA, 22 nt, Human
agguuucacuggugagagcaac

SEQ ID NO: 1376320 - RNA, 21 nt, Human
aguaagaaacaggcccuuuaa

SEQ ID NO: 1376321 - RNA, 20 nt, Human
agucauugcacagcaaagcc

SEQ ID NO: 1376322 - RNA, 22 nt, Human
cacuggaccgaaagccuccaac

SEQ ID NO: 1376323 - RNA, 22 nt, Human
caggccaguaagaaacaggccc

SEQ ID NO: 1376324 - RNA, 20 nt, Human
cagggcgucccccucaaccc

SEQ ID NO: 1376325 - RNA, 19 nt, Human
caggucaggaggucuggga

SEQ ID NO: 1376326 - RNA, 20 nt, Human
caggucaggaggucugggag

SEQ ID NO: 1376327 - RNA, 23 nt, Human
ccagucauugcacagcaaagcca

SEQ ID NO: 1376328 - RNA, 21 nt, Human
ccccacaucucucagccccac

SEQ ID NO: 1376329 - RNA, 20 nt, Human
cccugcccugaacaugcccc

SEQ ID NO: 1376330 - RNA, 23 nt, Human
ccugcaacuggggucccuggagc

SEQ ID NO: 1376331 - RNA, 22 nt, Human
cgaaagccuccaacacaaaccc

SEQ ID NO: 1376332 - RNA, 23 nt, Human
cgccagagagcacagcacccuag

SEQ ID NO: 1376333 - RNA, 21 nt, Human
cucaacccugcccugaacaug

SEQ ID NO: 1376334 - RNA, 23 nt, Human
cucaacccugcccugaaccgguu

SEQ ID NO: 1376335 - RNA, 23 nt, Human
cuccaacacaaacccuagcugcc

SEQ ID NO: 1376336 - RNA, 24 nt, Human
cucccaccugcuugggcccugcaa

SEQ ID NO: 1376337 - RNA, 20 nt, Human
cucugcugcugggagucucu

SEQ ID NO: 1376338 - RNA, 18 nt, Human
cuguggggcgccagagag

SEQ ID NO: 1376339 - RNA, 18 nt, Human
gagagcagcuuuaacaca

SEQ ID NO: 1376340 - RNA, 27 nt, Human
gcaacuggggucccuggagcuggccag

SEQ ID NO: 1376341 - RNA, 20 nt, Human
gcccaugccgggcggccuuc

SEQ ID NO: 1376342 - RNA, 20 nt, Human
gccuccaacacaaacccuag

SEQ ID NO: 1376343 - RNA, 21 nt, Human
gccuccaacacaaacccuagc

SEQ ID NO: 1376344 - RNA, 18 nt, Human
gccugagcaggaagcucc

SEQ ID NO: 1376345 - RNA, 21 nt, Human
gcuguggaccccuucaggugc

SEQ ID NO: 1376346 - RNA, 18 nt, Human
ggcgucccccucaacccu

SEQ ID NO: 1376347 - RNA, 22 nt, Human
ggcgucccccucaacccugccc

SEQ ID NO: 1376348 - RNA, 19 nt, Human
ggcuguggaccccuucagg

SEQ ID NO: 1376349 - RNA, 21 nt, Human
ggcuguggaccccuucaggug

SEQ ID NO: 1376350 - RNA, 25 nt, Human
gguuucacuggugagagcagcuuua

SEQ ID NO: 1376351 - RNA, 21 nt, Human
uaaagguuacagguuauagcu

SEQ ID NO: 1376352 - RNA, 18 nt, Human
uaacuccuucugagacag

SEQ ID NO: 1376353 - RNA, 18 nt, Human
uaagugugaaauaaaccu

SEQ ID NO: 1376354 - RNA, 20 nt, Human
ucaacccugcccugaacaug

SEQ ID NO: 1376355 - RNA, 21 nt, Human
ucaacccugcccugaacaugc

SEQ ID NO: 1376356 - RNA, 18 nt, Human
ucaggaggucugggaggc

SEQ ID NO: 1376357 - RNA, 25 nt, Human
uccaacacaaacccuagcugccaac

SEQ ID NO: 1376358 - RNA, 18 nt, Human
ucccuggagcuggccagg

SEQ ID NO: 1376359 - RNA, 22 nt, Human
ucccuggagcuggccaggcugu

SEQ ID NO: 1376360 - RNA, 23 nt, Human
ucucucagccccacuaaugcaga

SEQ ID NO: 1376361 - RNA, 23 nt, Human
ucuugagccucaaccacccaggu

SEQ ID NO: 1376362 - RNA, 26 nt, Human
ugagagcagcuuuaacacacaggccc

SEQ ID NO: 1376363 - RNA, 18 nt, Human
ugagccucaaccacccag

SEQ ID NO: 1376364 - RNA, 21 nt, Human
ugaggggcgaagccagugcuu

SEQ ID NO: 1376365 - RNA, 19 nt, Human
ugcaagacacuggaccgaa

SEQ ID NO: 1376366 - RNA, 23 nt, Human
ugccccagggcacugaggggcga

SEQ ID NO: 1376367 - RNA, 22 nt, Human
ugcugcugggagucucuggucu

SEQ ID NO: 1376368 - RNA, 21 nt, Human
ugggcccugcaacuggggucc

SEQ ID NO: 1376369 - RNA, 19 nt, Human
ugugaaauaaaccucucug

SEQ ID NO: 1376370 - RNA, 20 nt, Human
ugugaaauaaaccucucuga

SEQ ID NO: 1376371 - RNA, 19 nt, Human
ugugucugugugugccugu

SEQ ID NO: 1376372 - RNA, 20 nt, Human
uguuguaggacugcaagaca

SEQ ID NO: 1376373 - RNA, 23 nt, Human
uugggcucugcugcugggagucu

SEQ ID NO: 1376374 - RNA, 21 nt, Human
uuucuuagguuucacugguga

SEQ ID NO: 1376375 - RNA, 25 nt, Human
uuucuuagguuucacuggugagagc

SEQ ID NO: 1376376 - RNA, 22 nt, Human
aaaaacuuugaugacaggagca

SEQ ID NO: 1376377 - RNA, 24 nt, Human
aaaaagagagcucaaauccucaac

SEQ ID NO: 1376378 - RNA, 23 nt, Human
aaaacaaaacaaaacaaaaaggu

SEQ ID NO: 1376379 - RNA, 23 nt, Human
aaaacaaaacaaaacaaaacaaa

SEQ ID NO: 1376380 - RNA, 23 nt, Human
aaaacaaaacaaaacaaaacaaa

SEQ ID NO: 1376381 - RNA, 20 nt, Human
aaaacaguuuuaaacacuuu

SEQ ID NO: 1376382 - RNA, 18 nt, Human
aaaagacugaaaauaggc

SEQ ID NO: 1376383 - RNA, 20 nt, Human
aaaaucuccuuugggauuaa

SEQ ID NO: 1376384 - RNA, 19 nt, Human
aaacaaaacaaaacaaaaa

SEQ ID NO: 1376385 - RNA, 22 nt, Human
aaacaaaacaaaacaaaacaaa

SEQ ID NO: 1376386 - RNA, 22 nt, Human
aaacaaaacaaaacaaaacaaa

SEQ ID NO: 1376387 - RNA, 22 nt, Human
aaacaaaacaaaacaaaacaaa

SEQ ID NO: 1376388 - RNA, 22 nt, Human
aaacaaaacaaaacaaaacaaa

SEQ ID NO: 1376389 - RNA, 22 nt, Human
aaacaaaacaaaacaaaacaaa

SEQ ID NO: 1376390 - RNA, 21 nt, Human
aaacagcaccaugguuuuccc

SEQ ID NO: 1376391 - RNA, 28 nt, Human
aaaccagaauagaagcaaccucaaauac

SEQ ID NO: 1376392 - RNA, 21 nt, Human
aaagcacuaagguauaaagca

SEQ ID NO: 1376393 - RNA, 21 nt, Human
aaagcaugugcagcagccuuc

SEQ ID NO: 1376394 - RNA, 23 nt, Human
aacaaaacaaaaagguuaaguuu

SEQ ID NO: 1376395 - RNA, 19 nt, Human
aacaagaaccauaaaaagg

SEQ ID NO: 1376396 - RNA, 22 nt, Human
aacaagaaccauaaaaaggagc

SEQ ID NO: 1376397 - RNA, 18 nt, Human
aagcaaccucaaauacug

SEQ ID NO: 1376398 - RNA, 22 nt, Human
aaggagcagagggaugugggag

SEQ ID NO: 1376399 - RNA, 18 nt, Human
aauagaagcaaccucaaa

SEQ ID NO: 1376400 - RNA, 23 nt, Human
acaaaacaaaacaaaaagguuaa

SEQ ID NO: 1376401 - RNA, 21 nt, Human
acaaaacaaaacaaaacaaaa

SEQ ID NO: 1376402 - RNA, 21 nt, Human
acaaaacaaaacaaaacaaaa

SEQ ID NO: 1376403 - RNA, 21 nt, Human
acaaaacaaaacaaaacaaaa

SEQ ID NO: 1376404 - RNA, 27 nt, Human
acaaaacaaaacaaaacaaaacaaaaa

SEQ ID NO: 1376405 - RNA, 20 nt, Human
acaacaagaaccauaaaaag

SEQ ID NO: 1376406 - RNA, 20 nt, Human
acaagaaccauaaaaaggag

SEQ ID NO: 1376407 - RNA, 22 nt, Human
accauuuaaacauuacauuuaa

SEQ ID NO: 1376408 - RNA, 19 nt, Human
acuucacauccaaacaggu

SEQ ID NO: 1376409 - RNA, 21 nt, Human
agaaaaaaacaguuuuaaaca

SEQ ID NO: 1376410 - RNA, 20 nt, Human
agaauagaagcaaccucaaa

SEQ ID NO: 1376411 - RNA, 24 nt, Human
agaauagauagaucaaugaaggua

SEQ ID NO: 1376412 - RNA, 22 nt, Human
agcuaugaaaaguuccaagcag

SEQ ID NO: 1376413 - RNA, 20 nt, Human
agucucuacucauuuauggc

SEQ ID NO: 1376414 - RNA, 19 nt, Human
auaaaaaggagcagaggga

SEQ ID NO: 1376415 - RNA, 26 nt, Human
auaaaauaggcuuuccuuacaccccc

SEQ ID NO: 1376416 - RNA, 21 nt, Human
auaguuguugaguguucuaaa

SEQ ID NO: 1376417 - RNA, 18 nt, Human
aucaaguacugguccaau

SEQ ID NO: 1376418 - RNA, 18 nt, Human
auccaaacagguguggag

SEQ ID NO: 1376419 - RNA, 21 nt, Human
caaaacaaaacaaaaagguua

SEQ ID NO: 1376420 - RNA, 21 nt, Human
caaaacaaaacaaaacaaaac

SEQ ID NO: 1376421 - RNA, 21 nt, Human
caaaacaaaacaaaacaaaac

SEQ ID NO: 1376422 - RNA, 21 nt, Human
caaaacaaaacaaaacaaaac

SEQ ID NO: 1376423 - RNA, 21 nt, Human
caaaacaaaacaaaacaaaac

SEQ ID NO: 1376424 - RNA, 24 nt, Human
caaaacaaaacaaaacaaaacaaa

SEQ ID NO: 1376425 - RNA, 24 nt, Human
caaaacaaaacaaaacaaaacaaa

SEQ ID NO: 1376426 - RNA, 24 nt, Human
caaaacaaaacaaaacaaaacaaa

SEQ ID NO: 1376427 - RNA, 22 nt, Human
caaagcauauguuccuuuaaaa

SEQ ID NO: 1376428 - RNA, 23 nt, Human
caacacuaaagcacaauuugcca

SEQ ID NO: 1376429 - RNA, 19 nt, Human
cacacacccgcccaugggg

SEQ ID NO: 1376430 - RNA, 20 nt, Human
ccaagcaauacacuggaagc

SEQ ID NO: 1376431 - RNA, 23 nt, Human
ccauuuugguuucuccuuuuuca

SEQ ID NO: 1376432 - RNA, 23 nt, Human
cccaggaaccaugcauuuggggg

SEQ ID NO: 1376433 - RNA, 19 nt, Human
cccgccgccgccgccgcug

SEQ ID NO: 1376434 - RNA, 19 nt, Human
ccgccgccgccgccgcugc

SEQ ID NO: 1376435 - RNA, 22 nt, Human
ccgcugcagccuccuccggcgc

SEQ ID NO: 1376436 - RNA, 18 nt, Human
ccggugcccuccgaguuc

SEQ ID NO: 1376437 - RNA, 19 nt, Human
ccuccgaguucucguugag

SEQ ID NO: 1376438 - RNA, 19 nt, Human
ccucguccgccaccuccgg

SEQ ID NO: 1376439 - RNA, 22 nt, Human
cuaaaagacugaaaauaggcac

SEQ ID NO: 1376440 - RNA, 24 nt, Human
cuaaagcacaauuugccagucucu

SEQ ID NO: 1376441 - RNA, 19 nt, Human
cuaagaauaaaaaaccaga

SEQ ID NO: 1376442 - RNA, 24 nt, Human
cucaagauguggggaugaggaaag

SEQ ID NO: 1376443 - RNA, 19 nt, Human
cucagaaacaugauguuac

SEQ ID NO: 1376444 - RNA, 18 nt, Human
cuccaaauucaaccuaac

SEQ ID NO: 1376445 - RNA, 23 nt, Human
cugaaaauaggcacaguucuccc

SEQ ID NO: 1376446 - RNA, 18 nt, Human
cuggccaacagggcucag

SEQ ID NO: 1376447 - RNA, 22 nt, Human
cuggugcuguaucccaaaauuc

SEQ ID NO: 1376448 - RNA, 23 nt, Human
cuucaaaagcuggugcuguaucc

SEQ ID NO: 1376449 - RNA, 19 nt, Human
cuuuucaacugaguaucug

SEQ ID NO: 1376450 - RNA, 20 nt, Human
gaacagcuauaauugauuuu

SEQ ID NO: 1376451 - RNA, 24 nt, Human
gaaccaacuuuuaaaaggcuccaa

SEQ ID NO: 1376452 - RNA, 23 nt, Human
gaacuaaauccauucauagggaa

SEQ ID NO: 1376453 - RNA, 21 nt, Human
gaacuggaaagcacuaaggua

SEQ ID NO: 1376454 - RNA, 19 nt, Human
gacaaacuuugagaagugc

SEQ ID NO: 1376455 - RNA, 23 nt, Human
gacaacaagaaccauaaaaagga

SEQ ID NO: 1376456 - RNA, 21 nt, Human
gagcagagggaugugggagcu

SEQ ID NO: 1376457 - RNA, 23 nt, Human
gagcucaaauccucaacaaagaa

SEQ ID NO: 1376458 - RNA, 22 nt, Human
gcaacacuaaagcacaauuugc

SEQ ID NO: 1376459 - RNA, 19 nt, Human
gcagcaagaugacagcgac

SEQ ID NO: 1376460 - RNA, 20 nt, Human
gccgcagaguaggaaaugac

SEQ ID NO: 1376461 - RNA, 28 nt, Human
ggacaggcgcgccgcuccggcuucccag

SEQ ID NO: 1376462 - RNA, 18 nt, Human
ggcacaguggucacaugu

SEQ ID NO: 1376463 - RNA, 20 nt, Human
ggcuucguuauacagaccuu

SEQ ID NO: 1376464 - RNA, 19 nt, Human
ggucuucacuugaauuuag

SEQ ID NO: 1376465 - RNA, 21 nt, Human
gugcagcagccuucaaggccg

SEQ ID NO: 1376466 - RNA, 21 nt, Human
guggagggcugacauuuucca

SEQ ID NO: 1376467 - RNA, 25 nt, Human
guuacaauuacagauauauuuaauc

SEQ ID NO: 1376468 - RNA, 18 nt, Human
uaacuugcaaaaggcucu

SEQ ID NO: 1376469 - RNA, 18 nt, Human
uacaauuaaacagcacca

SEQ ID NO: 1376470 - RNA, 20 nt, Human
uacaauuacagauauauuua

SEQ ID NO: 1376471 - RNA, 23 nt, Human
uacccuaauaucuccaccucuaa

SEQ ID NO: 1376472 - RNA, 22 nt, Human
uacugcucuuuucaguuuccau

SEQ ID NO: 1376473 - RNA, 18 nt, Human
uacuuuuccaucucaugg

SEQ ID NO: 1376474 - RNA, 22 nt, Human
uaggaaaugacaacaagaacca

SEQ ID NO: 1376475 - RNA, 23 nt, Human
uaggaaaugacaacaagaaccau

SEQ ID NO: 1376476 - RNA, 21 nt, Human
uaguagugaccuucuaagccu

SEQ ID NO: 1376477 - RNA, 23 nt, Human
uaguuguccaucugucauaggau

SEQ ID NO: 1376478 - RNA, 25 nt, Human
uauacugauuuacccuaauaucucc

SEQ ID NO: 1376479 - RNA, 18 nt, Human
uauuaauugagcuaagaa

SEQ ID NO: 1376480 - RNA, 18 nt, Human
ucaggggcacagugguca

SEQ ID NO: 1376481 - RNA, 22 nt, Human
uccauuaaccaaaacaaaacaa

SEQ ID NO: 1376482 - RNA, 22 nt, Human
ucccaaaauucaucccucuugc

SEQ ID NO: 1376483 - RNA, 23 nt, Human
ucccaaaucucuuuccggccuuc

SEQ ID NO: 1376484 - RNA, 18 nt, Human
ucccucuugcugcguagu

SEQ ID NO: 1376485 - RNA, 19 nt, Human
ucccuggauuuuucagucc

SEQ ID NO: 1376486 - RNA, 20 nt, Human
ucccuggauuuuucaguccc

SEQ ID NO: 1376487 - RNA, 25 nt, Human
ucguccgggcccgccgccgccgccg

SEQ ID NO: 1376488 - RNA, 21 nt, Human
ucuccuuuuucaaaggcuggu

SEQ ID NO: 1376489 - RNA, 20 nt, Human
ucuugcugcguaguugucca

SEQ ID NO: 1376490 - RNA, 22 nt, Human
ugaaaauaggcacaguucuccc

SEQ ID NO: 1376491 - RNA, 23 nt, Human
ugaaauagauuucacgccgcaga

SEQ ID NO: 1376492 - RNA, 20 nt, Human
ugaacaaaaacuuugaugac

SEQ ID NO: 1376493 - RNA, 22 nt, Human
ugagaagugcugcuauucgaug

SEQ ID NO: 1376494 - RNA, 22 nt, Human
ugaggaaagcaacacuaaagca

SEQ ID NO: 1376495 - RNA, 21 nt, Human
ugaugacaucaccaaaucugc

SEQ ID NO: 1376496 - RNA, 21 nt, Human
ugcccgaggagucgugcuggg

SEQ ID NO: 1376497 - RNA, 18 nt, Human
uggaaagcacuaagguau

SEQ ID NO: 1376498 - RNA, 26 nt, Human
uggaaggcaccaaaauuuagugugaa

SEQ ID NO: 1376499 - RNA, 25 nt, Human
uggcacacaaaugaacaaaaacuuu

SEQ ID NO: 1376500 - RNA, 19 nt, Human
uggcucuuuguguuuuauu

SEQ ID NO: 1376501 - RNA, 20 nt, Human
ugggggcccccggcgccucg

SEQ ID NO: 1376502 - RNA, 22 nt, Human
ugguuucuccuuuuucaaaggc

SEQ ID NO: 1376503 - RNA, 22 nt, Human
ugugacaccaguaaaucuuuca

SEQ ID NO: 1376504 - RNA, 20 nt, Human
ugugcagcagccuucaaggc

SEQ ID NO: 1376505 - RNA, 22 nt, Human
uguuacaauuacagauauauuu

SEQ ID NO: 1376506 - RNA, 18 nt, Human
uguuauguuugcaccauc

SEQ ID NO: 1376507 - RNA, 22 nt, Human
uguuauguuugcaccaucaaug

SEQ ID NO: 1376508 - RNA, 22 nt, Human
uuaaaaaaagcacauaaacccu

SEQ ID NO: 1376509 - RNA, 24 nt, Human
uucaauaccauuuaaacauuacau

SEQ ID NO: 1376510 - RNA, 21 nt, Human
uucaucccucuugcugcguag

SEQ ID NO: 1376511 - RNA, 21 nt, Human
uuccaguugacaaacuuugag

SEQ ID NO: 1376512 - RNA, 22 nt, Human
uucuccuuuuucaaaggcuggu

SEQ ID NO: 1376513 - RNA, 21 nt, Human
uugggauuaaugcuguggucu

SEQ ID NO: 1376514 - RNA, 22 nt, Human
uugguuucuccuuuuucaaagg

SEQ ID NO: 1376515 - RNA, 25 nt, Human
uugucuguacuuuuccaucucaugg

SEQ ID NO: 1376516 - RNA, 19 nt, Human
uuuagugugaauguaaaua

SEQ ID NO: 1376517 - RNA, 18 nt, Human
uuucacacuuaaaaauuu

SEQ ID NO: 1376518 - RNA, 19 nt, Human
uuugggauuaaugcugugg

SEQ ID NO: 1376519 - RNA, 23 nt, Human
uuugguuucuccuuuuucaaagg

SEQ ID NO: 1376520 - RNA, 21 nt, Human
uuuuuuuuuuuuaaaaaaagc

SEQ ID NO: 1376521 - RNA, 22 nt, Human
aagugcagcacgccuauggaaa

SEQ ID NO: 1376522 - RNA, 19 nt, Human
agcuuuggcccuuuuugcu

SEQ ID NO: 1376523 - RNA, 22 nt, Human
cagauuuacaaguuuggaugcu

SEQ ID NO: 1376524 - RNA, 22 nt, Human
cagcacgccuauggaaagcuuu

SEQ ID NO: 1376525 - RNA, 24 nt, Human
ccaagcaagugcagcacgccuaug

SEQ ID NO: 1376526 - RNA, 20 nt, Human
ccuauggaaagcuuuggccc

SEQ ID NO: 1376527 - RNA, 22 nt, Human
cgccuauggaaagcuuuggccc

SEQ ID NO: 1376528 - RNA, 19 nt, Human
cgugugccagugccagugc

SEQ ID NO: 1376529 - RNA, 23 nt, Human
ggaaagcuuuggcccuuuuugcu

SEQ ID NO: 1376530 - RNA, 19 nt, Human
uaccaagcaagugcagcac

SEQ ID NO: 1376531 - RNA, 19 nt, Human
ugccagugccagugcuggu

SEQ ID NO: 1376532 - RNA, 21 nt, Human
uuuggcccuuuuugcuaagcu

SEQ ID NO: 1376533 - RNA, 21 nt, Human
uuuggcccuuuuugcuaagcu

SEQ ID NO: 1376534 - RNA, 24 nt, Human
aagaaaaaaaaagagaucacacag

SEQ ID NO: 1376535 - RNA, 19 nt, Human
acauauauacacacauaua

SEQ ID NO: 1376536 - RNA, 22 nt, Human
accucuuccuucccuuggccac

SEQ ID NO: 1376537 - RNA, 19 nt, Human
agacaaacagaaagcagug

SEQ ID NO: 1376538 - RNA, 21 nt, Human
aggcaaaaagaaaaaaaaaga

SEQ ID NO: 1376539 - RNA, 26 nt, Human
aggcaaaaagaaaaaaaaagggaccc

SEQ ID NO: 1376540 - RNA, 19 nt, Human
auaaaguguacauauauac

SEQ ID NO: 1376541 - RNA, 24 nt, Human
auaagauugggucaaaagaugaga

SEQ ID NO: 1376542 - RNA, 21 nt, Human
auauacacacauaaacauaua

SEQ ID NO: 1376543 - RNA, 18 nt, Human
caaacagaaagcaguggc

SEQ ID NO: 1376544 - RNA, 23 nt, Human
cacuuugcaauauacaaugagca

SEQ ID NO: 1376545 - RNA, 19 nt, Human
cauauauacacacauauau

SEQ ID NO: 1376546 - RNA, 23 nt, Human
cauauauacacacauauauguau

SEQ ID NO: 1376547 - RNA, 25 nt, Human
ccugcuccuuuucuucccccagaug

SEQ ID NO: 1376548 - RNA, 24 nt, Human
gaccucuuccuucccuuggccacc

SEQ ID NO: 1376549 - RNA, 21 nt, Human
gaugcagauaggcaaaaagaa

SEQ ID NO: 1376550 - RNA, 19 nt, Human
gcacggcacgcuugucugc

SEQ ID NO: 1376551 - RNA, 24 nt, Human
gcaguggcaacauuaauaacagaa

SEQ ID NO: 1376552 - RNA, 19 nt, Human
ggagguuuacauuucauuu

SEQ ID NO: 1376553 - RNA, 18 nt, Human
ggcaaaaagaaaaaaaaa

SEQ ID NO: 1376554 - RNA, 19 nt, Human
ggcaguaaggagcugguac

SEQ ID NO: 1376555 - RNA, 23 nt, Human
guguacauauauacacacauaua

SEQ ID NO: 1376556 - RNA, 27 nt, Human
guguacauauauacacacauauaugua

SEQ ID NO: 1376557 - RNA, 24 nt, Human
uaaaugaauaagauugggucaaaa

SEQ ID NO: 1376558 - RNA, 20 nt, Human
uacacuguuuugcaacucgu

SEQ ID NO: 1376559 - RNA, 22 nt, Human
uauacacacauauauguauaca

SEQ ID NO: 1376560 - RNA, 24 nt, Human
uauacacacauauauguauacacu

SEQ ID NO: 1376561 - RNA, 23 nt, Human
uauauacacacauauauguauac

SEQ ID NO: 1376562 - RNA, 24 nt, Human
uauauacacacauauauguauaca

SEQ ID NO: 1376563 - RNA, 18 nt, Human
uaucaagaaagugcagac

SEQ ID NO: 1376564 - RNA, 23 nt, Human
uaucaagaaagugcagacaaaca

SEQ ID NO: 1376565 - RNA, 24 nt, Human
uaucaagaaagugcagacaaacag

SEQ ID NO: 1376566 - RNA, 19 nt, Human
ucaagaaagugcagacaaa

SEQ ID NO: 1376567 - RNA, 18 nt, Human
uccaugcaaaugaaugag

SEQ ID NO: 1376568 - RNA, 18 nt, Human
ucugugaacacagauccu

SEQ ID NO: 1376569 - RNA, 19 nt, Human
ugagaagaugcagauaggc

SEQ ID NO: 1376570 - RNA, 19 nt, Human
ugcuuaacucugugcgggg

SEQ ID NO: 1376571 - RNA, 19 nt, Human
uggcaacauuaauaacaga

SEQ ID NO: 1376572 - RNA, 22 nt, Human
uguacauauauacacacauaua

SEQ ID NO: 1376573 - RNA, 20 nt, Human
ugucugugaacacagauccu

SEQ ID NO: 1376574 - RNA, 21 nt, Human
uucacuguuaaccuuuggugu

SEQ ID NO: 1376575 - RNA, 25 nt, Human
uucauuuuuuggcaagugagaagau

SEQ ID NO: 1376576 - RNA, 21 nt, Human
uuguuguuguuuccugcuuaa

SEQ ID NO: 1376577 - RNA, 24 nt, Human
uuuccaugcaaaugaaugagacua

SEQ ID NO: 1376578 - RNA, 20 nt, Human
uuuccugcuccuuuucuucc

SEQ ID NO: 1376579 - RNA, 19 nt, Human
aaaaugcagggauuacagg

SEQ ID NO: 1376580 - RNA, 24 nt, Human
aaaaugcagggauuacagguguga

SEQ ID NO: 1376581 - RNA, 19 nt, Human
aaguaggugggauuacaga

SEQ ID NO: 1376582 - RNA, 20 nt, Human
aaguguaggacagggagggg

SEQ ID NO: 1376583 - RNA, 18 nt, Human
acagacgcacaccaccau

SEQ ID NO: 1376584 - RNA, 19 nt, Human
acgcacaccaccaugccca

SEQ ID NO: 1376585 - RNA, 25 nt, Human
acucuaaaacuuuugcaaaaacagg

SEQ ID NO: 1376586 - RNA, 24 nt, Human
acucuuguugcccaggcuggagug

SEQ ID NO: 1376587 - RNA, 23 nt, Human
agaugggguuucaucauauuggu

SEQ ID NO: 1376588 - RNA, 22 nt, Human
agggaggggcagaaucuacagg

SEQ ID NO: 1376589 - RNA, 20 nt, Human
agggagggggcagcggcggg

SEQ ID NO: 1376590 - RNA, 22 nt, Human
agggagggggcagcggcggguc

SEQ ID NO: 1376591 - RNA, 24 nt, Human
agggagggggcagcggcggguugg

SEQ ID NO: 1376592 - RNA, 22 nt, Human
agggauuacaggugugagccac

SEQ ID NO: 1376593 - RNA, 23 nt, Human
agggauuacaggugugagccacc

SEQ ID NO: 1376594 - RNA, 24 nt, Human
agggauuacaggugugagccacca

SEQ ID NO: 1376595 - RNA, 20 nt, Human
agggggcagcggcggguugg

SEQ ID NO: 1376596 - RNA, 21 nt, Human
agggggcagcggcggguugga

SEQ ID NO: 1376597 - RNA, 21 nt, Human
agguucaagugauucuccugc

SEQ ID NO: 1376598 - RNA, 22 nt, Human
agguucaagugauucuccugcc

SEQ ID NO: 1376599 - RNA, 22 nt, Human
aguacagaugggguuucaucau

SEQ ID NO: 1376600 - RNA, 24 nt, Human
agugauucuccugccucagucucc

SEQ ID NO: 1376601 - RNA, 24 nt, Human
aucauauuggucaggcuggucucg

SEQ ID NO: 1376602 - RNA, 20 nt, Human
augggguuucaucauauugg

SEQ ID NO: 1376603 - RNA, 23 nt, Human
augggguuucaucauauugguca

SEQ ID NO: 1376604 - RNA, 24 nt, Human
augggguuucaucauauuggucag

SEQ ID NO: 1376605 - RNA, 22 nt, Human
auuacugaugcuucacccagau

SEQ ID NO: 1376606 - RNA, 18 nt, Human
auucuccugccucagucu

SEQ ID NO: 1376607 - RNA, 24 nt, Human
caaaaaugcagggauuacaggugu

SEQ ID NO: 1376608 - RNA, 26 nt, Human
caaaugccacacgacuuggacgcagu

SEQ ID NO: 1376609 - RNA, 23 nt, Human
caagaaugagugaagugaagcca

SEQ ID NO: 1376610 - RNA, 21 nt, Human
caagugauucuccugccucag

SEQ ID NO: 1376611 - RNA, 28 nt, Human
caagugauucuccugccucagucuccca

SEQ ID NO: 1376612 - RNA, 24 nt, Human
cacaccaccaugcccagcuaauuu

SEQ ID NO: 1376613 - RNA, 24 nt, Human
caccaugcccagcuaauuuuugua

SEQ ID NO: 1376614 - RNA, 23 nt, Human
caccaugccuggccagcccacag

SEQ ID NO: 1376615 - RNA, 19 nt, Human
caccuagccgaacccaaag

SEQ ID NO: 1376616 - RNA, 18 nt, Human
cacugcaaccucugccuc

SEQ ID NO: 1376617 - RNA, 21 nt, Human
cacugcaaccucugccuccca

SEQ ID NO: 1376618 - RNA, 18 nt, Human
cagauacuugagguggug

SEQ ID NO: 1376619 - RNA, 25 nt, Human
cagccuccacuccauuuucauuacu

SEQ ID NO: 1376620 - RNA, 22 nt, Human
caggcuuauuucggaagcauua

SEQ ID NO: 1376621 - RNA, 18 nt, Human
cauauuggucaggcuggu

SEQ ID NO: 1376622 - RNA, 21 nt, Human
cauauuggucaggcuggucuc

SEQ ID NO: 1376623 - RNA, 24 nt, Human
caucauauuggucaggcuggucuc

SEQ ID NO: 1376624 - RNA, 19 nt, Human
cauugccacccacauucca

SEQ ID NO: 1376625 - RNA, 21 nt, Human
ccaaaugccacacgacuugga

SEQ ID NO: 1376626 - RNA, 18 nt, Human
ccaagcaaguguaggaca

SEQ ID NO: 1376627 - RNA, 18 nt, Human
ccacccaaaaaugcaggg

SEQ ID NO: 1376628 - RNA, 20 nt, Human
ccacgcaccucugccaccca

SEQ ID NO: 1376629 - RNA, 22 nt, Human
ccagcccacaggacuucuagcc

SEQ ID NO: 1376630 - RNA, 20 nt, Human
ccagucacucacauucccag

SEQ ID NO: 1376631 - RNA, 19 nt, Human
ccauuuucauuacugaugc

SEQ ID NO: 1376632 - RNA, 23 nt, Human
cccaaaaaugcagggauuacagg

SEQ ID NO: 1376633 - RNA, 21 nt, Human
cccaagagcaaagugauuacc

SEQ ID NO: 1376634 - RNA, 19 nt, Human
cccaaguaggugggauuac

SEQ ID NO: 1376635 - RNA, 23 nt, Human
cccagguucaagugauucuccuc

SEQ ID NO: 1376636 - RNA, 23 nt, Human
cccagguucaagugauucuccug

SEQ ID NO: 1376637 - RNA, 22 nt, Human
ccccaagagcaaagugauuacc

SEQ ID NO: 1376638 - RNA, 22 nt, Human
ccucaggugauccacgcaccuc

SEQ ID NO: 1376639 - RNA, 24 nt, Human
ccucccagguucaagugauucucc

SEQ ID NO: 1376640 - RNA, 19 nt, Human
ccucugccacccaaaaaug

SEQ ID NO: 1376641 - RNA, 20 nt, Human
ccugaccucaggugauccac

SEQ ID NO: 1376642 - RNA, 21 nt, Human
ccugaccucaggugauccacg

SEQ ID NO: 1376643 - RNA, 24 nt, Human
ccugaccucaggugauccacgcac

SEQ ID NO: 1376644 - RNA, 23 nt, Human
ccuuggccacgguuccccaagag

SEQ ID NO: 1376645 - RNA, 23 nt, Human
cgcacaccaccaugcccagcuaa

SEQ ID NO: 1376646 - RNA, 18 nt, Human
cgcaccucugccacccaa

SEQ ID NO: 1376647 - RNA, 21 nt, Human
cggguuggaacuacccaacuc

SEQ ID NO: 1376648 - RNA, 24 nt, Human
cucacugcaaccucugccucccag

SEQ ID NO: 1376649 - RNA, 24 nt, Human
cucacugcaaccucugccucccag

SEQ ID NO: 1376650 - RNA, 24 nt, Human
cucaggugauccacgcaccucugc

SEQ ID NO: 1376651 - RNA, 19 nt, Human
cucccagguucaagugauu

SEQ ID NO: 1376652 - RNA, 23 nt, Human
cucucaagaggcccaagaagcuu

SEQ ID NO: 1376653 - RNA, 18 nt, Human
cucuuguugcccaggcug

SEQ ID NO: 1376654 - RNA, 22 nt, Human
cucuuguugcccaggcuggagu

SEQ ID NO: 1376655 - RNA, 21 nt, Human
cugaugcuucacccagauggu

SEQ ID NO: 1376656 - RNA, 23 nt, Human
cugcaaccucugccucccagguu

SEQ ID NO: 1376657 - RNA, 24 nt, Human
cugcaaccucugccucccagguuc

SEQ ID NO: 1376658 - RNA, 23 nt, Human
cugcuggauuuuccacauccagc

SEQ ID NO: 1376659 - RNA, 24 nt, Human
cuggaguguaauagcaugaucucg

SEQ ID NO: 1376660 - RNA, 21 nt, Human
cuuacaagccucucaagaggc

SEQ ID NO: 1376661 - RNA, 23 nt, Human
cuucauggcugccacaccaugcc

SEQ ID NO: 1376662 - RNA, 24 nt, Human
cuuguugcccaggcuggaguguaa

SEQ ID NO: 1376663 - RNA, 18 nt, Human
cuuuggaggcagggcagc

SEQ ID NO: 1376664 - RNA, 27 nt, Human
gaacuacccaacucacuguacuacuua

SEQ ID NO: 1376665 - RNA, 24 nt, Human
gacagggagggggcagcggcgggu

SEQ ID NO: 1376666 - RNA, 24 nt, Human
gaccucaggugauccacgcaccuc

SEQ ID NO: 1376667 - RNA, 22 nt, Human
gauuacagacgcacaccaccau

SEQ ID NO: 1376668 - RNA, 18 nt, Human
gauuacaggugugagcca

SEQ ID NO: 1376669 - RNA, 21 nt, Human
gauuacaggugugagccacca

SEQ ID NO: 1376670 - RNA, 24 nt, Human
gauuacaggugugagccaccaugc

SEQ ID NO: 1376671 - RNA, 22 nt, Human
gcccagcuaauuuuuguauuuu

SEQ ID NO: 1376672 - RNA, 18 nt, Human
gccucagucucccaagua

SEQ ID NO: 1376673 - RNA, 18 nt, Human
gcugagccucuuuggagg

SEQ ID NO: 1376674 - RNA, 19 nt, Human
gcugccacaccaugccagg

SEQ ID NO: 1376675 - RNA, 23 nt, Human
gcuggucucgaacuccugaccuc

SEQ ID NO: 1376676 - RNA, 21 nt, Human
ggagaaaaacugagcaaggca

SEQ ID NO: 1376677 - RNA, 24 nt, Human
ggauuacaggugugagccaccaug

SEQ ID NO: 1376678 - RNA, 24 nt, Human
ggcuggucucgaacuccugaccuc

SEQ ID NO: 1376679 - RNA, 21 nt, Human
ggcuggugaaugggagacggc

SEQ ID NO: 1376680 - RNA, 18 nt, Human
gggacuucucaaucugaa

SEQ ID NO: 1376681 - RNA, 19 nt, Human
gggagggggcagcggcggg

SEQ ID NO: 1376682 - RNA, 22 nt, Human
gggagggggcagcggcggguug

SEQ ID NO: 1376683 - RNA, 23 nt, Human
gggauuacaggugugagccacca

SEQ ID NO: 1376684 - RNA, 24 nt, Human
gggauuacaggugugagccaccau

SEQ ID NO: 1376685 - RNA, 18 nt, Human
gggcagaagggaggggca

SEQ ID NO: 1376686 - RNA, 22 nt, Human
gggguuucaucauauuggucag

SEQ ID NO: 1376687 - RNA, 22 nt, Human
ggguuucaucauauuggucagg

SEQ ID NO: 1376688 - RNA, 19 nt, Human
ggucucgaacuccugaccu

SEQ ID NO: 1376689 - RNA, 19 nt, Human
guauuuuuaguacagaugg

SEQ ID NO: 1376690 - RNA, 22 nt, Human
guccacuuggaaacacgcugcc

SEQ ID NO: 1376691 - RNA, 20 nt, Human
guguccuauaaaagugggac

SEQ ID NO: 1376692 - RNA, 23 nt, Human
uaacccaagcaaguguaggacag

SEQ ID NO: 1376693 - RNA, 24 nt, Human
uaauuuuuguauuuuuaguacaga

SEQ ID NO: 1376694 - RNA, 22 nt, Human
uacaggugugagccaccaugcc

SEQ ID NO: 1376695 - RNA, 22 nt, Human
uacaggugugagccaccaugcc

SEQ ID NO: 1376696 - RNA, 21 nt, Human
uacuugaggugguggaaggga

SEQ ID NO: 1376697 - RNA, 23 nt, Human
uagcagcuggggccaccagucac

SEQ ID NO: 1376698 - RNA, 23 nt, Human
uaguacagaugggguuucaucau

SEQ ID NO: 1376699 - RNA, 24 nt, Human
uaguacagaugggguuucaucaua

SEQ ID NO: 1376700 - RNA, 24 nt, Human
uauagugcguggacacuggaaaag

SEQ ID NO: 1376701 - RNA, 31 nt, Human
uaucauggagccuccgacagauacuugaggg

SEQ ID NO: 1376702 - RNA, 24 nt, Human
ucaaaucagaaaagagaggccaac

SEQ ID NO: 1376703 - RNA, 19 nt, Human
ucaagugauucuccugccu

SEQ ID NO: 1376704 - RNA, 23 nt, Human
ucacucuuguugcccaggcugga

SEQ ID NO: 1376705 - RNA, 19 nt, Human
ucacugcaaccucugccuc

SEQ ID NO: 1376706 - RNA, 24 nt, Human
ucacugcaaccucugccucccagg

SEQ ID NO: 1376707 - RNA, 25 nt, Human
ucacugcaaccucugccucccaggu

SEQ ID NO: 1376708 - RNA, 23 nt, Human
ucagaaaagagaggccaacaacu

SEQ ID NO: 1376709 - RNA, 18 nt, Human
ucccagaagcagaagauc

SEQ ID NO: 1376710 - RNA, 21 nt, Human
ucccagguucaagugauucuc

SEQ ID NO: 1376711 - RNA, 24 nt, Human
ucccagguucaagugauucuccug

SEQ ID NO: 1376712 - RNA, 25 nt, Human
ucccuugcugagccucuuuggaggc

SEQ ID NO: 1376713 - RNA, 21 nt, Human
ucuaagacaucaucaaaccuu

SEQ ID NO: 1376714 - RNA, 23 nt, Human
ucuaagacaucaucaaaccuuag

SEQ ID NO: 1376715 - RNA, 18 nt, Human
ucuacaggacucagugaa

SEQ ID NO: 1376716 - RNA, 23 nt, Human
ucucgaacuccugaccucaggug

SEQ ID NO: 1376717 - RNA, 19 nt, Human
ucucugaacacaagaaccc

SEQ ID NO: 1376718 - RNA, 23 nt, Human
ucucugaacacaagaacccugga

SEQ ID NO: 1376719 - RNA, 22 nt, Human
ucuuguugcccaggcuggagug

SEQ ID NO: 1376720 - RNA, 21 nt, Human
ugaacacaagaacccuggaug

SEQ ID NO: 1376721 - RNA, 23 nt, Human
ugaccucaggugauccacgcacc

SEQ ID NO: 1376722 - RNA, 23 nt, Human
ugagacagaguuucacucuuguu

SEQ ID NO: 1376723 - RNA, 22 nt, Human
ugaggugguggaagggaagcag

SEQ ID NO: 1376724 - RNA, 19 nt, Human
ugccacacgacuuggacgc

SEQ ID NO: 1376725 - RNA, 23 nt, Human
ugccauacucaccuucugucuca

SEQ ID NO: 1376726 - RNA, 22 nt, Human
ugcccaggcuggaguguaauag

SEQ ID NO: 1376727 - RNA, 20 nt, Human
ugccucagucucccaaguag

SEQ ID NO: 1376728 - RNA, 21 nt, Human
ugcguucccagcucaagucac

SEQ ID NO: 1376729 - RNA, 19 nt, Human
ugcugagccucuuuggagg

SEQ ID NO: 1376730 - RNA, 24 nt, Human
uggaaaaggucaaugcagccucca

SEQ ID NO: 1376731 - RNA, 24 nt, Human
uggaaacacgcugccaaaugccac

SEQ ID NO: 1376732 - RNA, 18 nt, Human
uggaagggaagcagggcc

SEQ ID NO: 1376733 - RNA, 24 nt, Human
uggaguguaauagcaugaucucgg

SEQ ID NO: 1376734 - RNA, 21 nt, Human
ugggauuacagacgcacacca

SEQ ID NO: 1376735 - RNA, 22 nt, Human
ugggauuacagacgcacaccac

SEQ ID NO: 1376736 - RNA, 24 nt, Human
ugggauuacagacgcacaccacca

SEQ ID NO: 1376737 - RNA, 24 nt, Human
ugggguuucaucauauuggucagg

SEQ ID NO: 1376738 - RNA, 23 nt, Human
ugggucucugaacacaagaaccc

SEQ ID NO: 1376739 - RNA, 24 nt, Human
uggucaggcuggucucgaacuccu

SEQ ID NO: 1376740 - RNA, 18 nt, Human
uguaggacagggaggggg

SEQ ID NO: 1376741 - RNA, 26 nt, Human
uguaggacagggagggggcagcggcg

SEQ ID NO: 1376742 - RNA, 21 nt, Human
uguauuuuuaguacagauggg

SEQ ID NO: 1376743 - RNA, 20 nt, Human
uguugcccaggcuggagugu

SEQ ID NO: 1376744 - RNA, 22 nt, Human
uuacaagccucucaagaggccc

SEQ ID NO: 1376745 - RNA, 18 nt, Human
uuaguacagaugggguuu

SEQ ID NO: 1376746 - RNA, 20 nt, Human
uuaguacagaugggguuuca

SEQ ID NO: 1376747 - RNA, 24 nt, Human
uuaguacagaugggguuucaucau

SEQ ID NO: 1376748 - RNA, 21 nt, Human
uucaagugauucuccugccuc

SEQ ID NO: 1376749 - RNA, 23 nt, Human
uucaagugauucuccugccucag

SEQ ID NO: 1376750 - RNA, 25 nt, Human
uucaagugauucuccugccucaguc

SEQ ID NO: 1376751 - RNA, 24 nt, Human
uucacucuuguugcccaggcugga

SEQ ID NO: 1376752 - RNA, 18 nt, Human
uugcccaggcuggagugu

SEQ ID NO: 1376753 - RNA, 19 nt, Human
uuggaaaaugccaaacucu

SEQ ID NO: 1376754 - RNA, 23 nt, Human
uuguauuuuuaguacagaugggg

SEQ ID NO: 1376755 - RNA, 23 nt, Human
uuguuggaaaaugccaaacucua

SEQ ID NO: 1376756 - RNA, 24 nt, Human
uuucacucuuguugcccaggcugg

SEQ ID NO: 1376757 - RNA, 24 nt, Human
uuucaucauauuggucaggcuggu

SEQ ID NO: 1376758 - RNA, 23 nt, Human
uuuccacauccagcugacaguca

SEQ ID NO: 1376759 - RNA, 24 nt, Human
uuuuuaguacagaugggguuucau

SEQ ID NO: 1376760 - RNA, 20 nt, Human
uuuuuguauuuuuaguacag

SEQ ID NO: 1376761 - RNA, 23 nt, Human
uuuuuguauuuuuaguacagaug

SEQ ID NO: 1376762 - RNA, 24 nt, Human
aaagugcugggauuacaggcguga

SEQ ID NO: 1376763 - RNA, 24 nt, Human
aacagccuaauuggaccacaaaag

SEQ ID NO: 1376764 - RNA, 19 nt, Human
aagaagaaugaaaauggau

SEQ ID NO: 1376765 - RNA, 19 nt, Human
aagugcugggauuacaggc

SEQ ID NO: 1376766 - RNA, 19 nt, Human
aagugcugggauuacaggc

SEQ ID NO: 1376767 - RNA, 26 nt, Human
aagugcugggauuacaggcgugagcc

SEQ ID NO: 1376768 - RNA, 21 nt, Human
aauacugcaucaaaaggcaga

SEQ ID NO: 1376769 - RNA, 24 nt, Human
aaugaaaacugcauuagucaccac

SEQ ID NO: 1376770 - RNA, 22 nt, Human
acaggugugcaccaccacaccc

SEQ ID NO: 1376771 - RNA, 24 nt, Human
accauguuggccaaccuggucucg

SEQ ID NO: 1376772 - RNA, 23 nt, Human
accuggcuuccuguguaugccug

SEQ ID NO: 1376773 - RNA, 18 nt, Human
acuccguugcccaggcug

SEQ ID NO: 1376774 - RNA, 19 nt, Human
acuccguugcccaggcugg

SEQ ID NO: 1376775 - RNA, 26 nt, Human
acuccguugcccaggcugggagugca

SEQ ID NO: 1376776 - RNA, 20 nt, Human
acugcaucaaaaggcagaau

SEQ ID NO: 1376777 - RNA, 22 nt, Human
acugcuucauagaccccuccug

SEQ ID NO: 1376778 - RNA, 18 nt, Human
agaauuaagccccugagc

SEQ ID NO: 1376779 - RNA, 18 nt, Human
agccuccugaguagcuag

SEQ ID NO: 1376780 - RNA, 19 nt, Human
aggaagcugcagcccaccc

SEQ ID NO: 1376781 - RNA, 18 nt, Human
aggacaaggucugacaac

SEQ ID NO: 1376782 - RNA, 23 nt, Human
aggcggccgaccuucggcccgag

SEQ ID NO: 1376783 - RNA, 21 nt, Human
agugcaguggcacgaucucag

SEQ ID NO: 1376784 - RNA, 23 nt, Human
agugcaguggcacgaucucagcu

SEQ ID NO: 1376785 - RNA, 18 nt, Human
agugcugggauuacaggc

SEQ ID NO: 1376786 - RNA, 18 nt, Human
auggggucucaccauguu

SEQ ID NO: 1376787 - RNA, 20 nt, Human
auggggucucaccauguugg

SEQ ID NO: 1376788 - RNA, 19 nt, Human
auguccuccucucuucauc

SEQ ID NO: 1376789 - RNA, 24 nt, Human
caaagugcugggauuacaggcgug

SEQ ID NO: 1376790 - RNA, 22 nt, Human
caagcgauucuccugccucagc

SEQ ID NO: 1376791 - RNA, 21 nt, Human
cacagccucgccgccuccuuc

SEQ ID NO: 1376792 - RNA, 24 nt, Human
caccacacccggcuaauuuuugua

SEQ ID NO: 1376793 - RNA, 21 nt, Human
caccauguuggccaaccuggu

SEQ ID NO: 1376794 - RNA, 24 nt, Human
caccauguuggccaaccuggucuc

SEQ ID NO: 1376795 - RNA, 22 nt, Human
caccggggcgccgggacggcga

SEQ ID NO: 1376796 - RNA, 25 nt, Human
cacuccguugcccaggcugggagug

SEQ ID NO: 1376797 - RNA, 18 nt, Human
cacucugcauuugagagc

SEQ ID NO: 1376798 - RNA, 21 nt, Human
cacugcaaccuccgccuccca

SEQ ID NO: 1376799 - RNA, 24 nt, Human
cagaaugaaaacugcauuagucac

SEQ ID NO: 1376800 - RNA, 22 nt, Human
cagagauggggucucaccaugu

SEQ ID NO: 1376801 - RNA, 21 nt, Human
cagcacgcuggggagaagggu

SEQ ID NO: 1376802 - RNA, 22 nt, Human
cagccaggacaaggucugacaa

SEQ ID NO: 1376803 - RNA, 19 nt, Human
cagccuccugaguagcuag

SEQ ID NO: 1376804 - RNA, 20 nt, Human
ccaaagugcugggauuacag

SEQ ID NO: 1376805 - RNA, 22 nt, Human
ccaaagugcugggauuacaggc

SEQ ID NO: 1376806 - RNA, 22 nt, Human
ccaaagugcugggauuacaggc

SEQ ID NO: 1376807 - RNA, 24 nt, Human
ccaaagugcugggauuacaggcgu

SEQ ID NO: 1376808 - RNA, 22 nt, Human
ccaggacugcuucauagacccc

SEQ ID NO: 1376809 - RNA, 20 nt, Human
cccagguucaagcgauucuc

SEQ ID NO: 1376810 - RNA, 23 nt, Human
cccagguucaagcgauucuccug

SEQ ID NO: 1376811 - RNA, 24 nt, Human
ccccaggacugcuucauagacccc

SEQ ID NO: 1376812 - RNA, 27 nt, Human
ccccaggacugcuucauagaccccucc

SEQ ID NO: 1376813 - RNA, 21 nt, Human
ccccuccugcccuuuuuccuu

SEQ ID NO: 1376814 - RNA, 19 nt, Human
ccccugagcagccaggaca

SEQ ID NO: 1376815 - RNA, 25 nt, Human
ccccugagcagccaggacaaggucu

SEQ ID NO: 1376816 - RNA, 18 nt, Human
cccgugacauugcucgug

SEQ ID NO: 1376817 - RNA, 22 nt, Human
cccgugacauugcucguguccg

SEQ ID NO: 1376818 - RNA, 18 nt, Human
cccuccugcccuuuuucc

SEQ ID NO: 1376819 - RNA, 18 nt, Human
ccgcagggacgcggacac

SEQ ID NO: 1376820 - RNA, 21 nt, Human
ccgccgcacagccucgccgcc

SEQ ID NO: 1376821 - RNA, 22 nt, Human
ccgccgcacagccucgccgccu

SEQ ID NO: 1376822 - RNA, 24 nt, Human
ccgccucccagguucaagcgauuc

SEQ ID NO: 1376823 - RNA, 24 nt, Human
ccucccagguucaagcgauucucc

SEQ ID NO: 1376824 - RNA, 21 nt, Human
ccuccugcccuuuuuccuuca

SEQ ID NO: 1376825 - RNA, 22 nt, Human
ccugaccucaggugaucucccc

SEQ ID NO: 1376826 - RNA, 23 nt, Human
ccugccucagccuccugaguagc

SEQ ID NO: 1376827 - RNA, 20 nt, Human
ccuucggcccgaggcaccgg

SEQ ID NO: 1376828 - RNA, 18 nt, Human
ccuugccccgggggcagg

SEQ ID NO: 1376829 - RNA, 23 nt, Human
cgccgggacggcgaagaugucgg

SEQ ID NO: 1376830 - RNA, 24 nt, Human
cgccucggccucccaaagugcugg

SEQ ID NO: 1376831 - RNA, 23 nt, Human
cuaauuuuuguauuuuuagcaga

SEQ ID NO: 1376832 - RNA, 24 nt, Human
cucacugcaaccuccgccucccag

SEQ ID NO: 1376833 - RNA, 24 nt, Human
cuccugaguagcuaggauaacagg

SEQ ID NO: 1376834 - RNA, 23 nt, Human
cugcaaccuccgccucccagguu

SEQ ID NO: 1376835 - RNA, 24 nt, Human
cugcaaccuccgccucccagguuc

SEQ ID NO: 1376836 - RNA, 23 nt, Human
cugccucagccuccugaguagcu

SEQ ID NO: 1376837 - RNA, 23 nt, Human
cuggcuuccuguguaugccuggg

SEQ ID NO: 1376838 - RNA, 23 nt, Human
cuggucucgaacuccugaccucc

SEQ ID NO: 1376839 - RNA, 18 nt, Human
cugugagcaagaggaagc

SEQ ID NO: 1376840 - RNA, 19 nt, Human
cuuaggggaaaaaaaaaag

SEQ ID NO: 1376841 - RNA, 24 nt, Human
gaccucaggugaucuccccgccuc

SEQ ID NO: 1376842 - RNA, 18 nt, Human
gaggcaccggggcgccgg

SEQ ID NO: 1376843 - RNA, 18 nt, Human
gauuacaggcgugagcca

SEQ ID NO: 1376844 - RNA, 21 nt, Human
gauuacaggcgugagccacgc

SEQ ID NO: 1376845 - RNA, 21 nt, Human
gauucuccugccucagccucc

SEQ ID NO: 1376846 - RNA, 22 nt, Human
gcaaccuccgccucccagguuc

SEQ ID NO: 1376847 - RNA, 21 nt, Human
gccgcacagccucgccgccuc

SEQ ID NO: 1376848 - RNA, 20 nt, Human
gccgggaguggggccgcagg

SEQ ID NO: 1376849 - RNA, 22 nt, Human
gccuccggccccucuuugcaac

SEQ ID NO: 1376850 - RNA, 24 nt, Human
gcgauucuccugccucagccuccu

SEQ ID NO: 1376851 - RNA, 21 nt, Human
ggcccgaggcaccggggcgcc

SEQ ID NO: 1376852 - RNA, 25 nt, Human
ggcugggagugcaguggcacgaucu

SEQ ID NO: 1376853 - RNA, 22 nt, Human
ggcuuaggggaaaaaaaaaagc

SEQ ID NO: 1376854 - RNA, 21 nt, Human
gggacgcggacacgucagacc

SEQ ID NO: 1376855 - RNA, 19 nt, Human
gggagugcaguggcacgau

SEQ ID NO: 1376856 - RNA, 19 nt, Human
gggaguggggccgcaggga

SEQ ID NO: 1376857 - RNA, 22 nt, Human
gggcagcccucacccuggugag

SEQ ID NO: 1376858 - RNA, 18 nt, Human
ggggucucaccauguugg

SEQ ID NO: 1376859 - RNA, 21 nt, Human
gggucucaccauguuggccaa

SEQ ID NO: 1376860 - RNA, 18 nt, Human
ggucacggcggccgggag

SEQ ID NO: 1376861 - RNA, 18 nt, Human
ggucucaccauguuggcc

SEQ ID NO: 1376862 - RNA, 19 nt, Human
ggucucgaacuccugaccu

SEQ ID NO: 1376863 - RNA, 20 nt, Human
ggucucgaacuccugaccuc

SEQ ID NO: 1376864 - RNA, 24 nt, Human
gugaucuccccgccucggccuccc

SEQ ID NO: 1376865 - RNA, 23 nt, Human
uaagcucccagugcaggguugac

SEQ ID NO: 1376866 - RNA, 24 nt, Human
uaauuuuuguauuuuuagcagaga

SEQ ID NO: 1376867 - RNA, 22 nt, Human
uacaggcgugagccacgcgccc

SEQ ID NO: 1376868 - RNA, 20 nt, Human
uacugcaucaaaaggcagag

SEQ ID NO: 1376869 - RNA, 24 nt, Human
uagcagagauggggucucaccaug

SEQ ID NO: 1376870 - RNA, 26 nt, Human
uagcagagauggggucucaccauguu

SEQ ID NO: 1376871 - RNA, 19 nt, Human
ucaccgccuaugauggugu

SEQ ID NO: 1376872 - RNA, 19 nt, Human
ucacugcaaccuccgccuc

SEQ ID NO: 1376873 - RNA, 24 nt, Human
ucacugcaaccuccgccucccagg

SEQ ID NO: 1376874 - RNA, 25 nt, Human
ucacugcaaccuccgccucccaggu

SEQ ID NO: 1376875 - RNA, 27 nt, Human
ucacugcaaccuccgccucccagguuc

SEQ ID NO: 1376876 - RNA, 19 nt, Human
ucagaaacugcaggagauc

SEQ ID NO: 1376877 - RNA, 27 nt, Human
ucagcucacugcaaccuccgccuccca

SEQ ID NO: 1376878 - RNA, 24 nt, Human
ucccaaagugcugggauuacaggc

SEQ ID NO: 1376879 - RNA, 21 nt, Human
ucccagguucaagcgauucuc

SEQ ID NO: 1376880 - RNA, 24 nt, Human
ucccagguucaagcgauucuccug

SEQ ID NO: 1376881 - RNA, 25 nt, Human
ucccuggccccucuuuaccuggcuu

SEQ ID NO: 1376882 - RNA, 18 nt, Human
ucgcggcgcgcggcgggg

SEQ ID NO: 1376883 - RNA, 18 nt, Human
ucggccucccaaagugcu

SEQ ID NO: 1376884 - RNA, 21 nt, Human
ucucaccauguuggccaaccu

SEQ ID NO: 1376885 - RNA, 23 nt, Human
ucucacuccguugcccaggcugg

SEQ ID NO: 1376886 - RNA, 23 nt, Human
ucucacuccguugcccaggcugg

SEQ ID NO: 1376887 - RNA, 24 nt, Human
ucucacuccguugcccaggcuggg

SEQ ID NO: 1376888 - RNA, 24 nt, Human
ucucacuccguugcccaggcuggg

SEQ ID NO: 1376889 - RNA, 25 nt, Human
ucucacuccguugcccaggcuggga

SEQ ID NO: 1376890 - RNA, 24 nt, Human
ucuccugccucagccuccugagua

SEQ ID NO: 1376891 - RNA, 19 nt, Human
ucucgaacuccugaccuca

SEQ ID NO: 1376892 - RNA, 19 nt, Human
ugaccucaggugaucuccc

SEQ ID NO: 1376893 - RNA, 20 nt, Human
ugaccucaggugaucucccc

SEQ ID NO: 1376894 - RNA, 21 nt, Human
ugaccucaggugaucuccccg

SEQ ID NO: 1376895 - RNA, 24 nt, Human
ugaccucaggugaucuccccgccu

SEQ ID NO: 1376896 - RNA, 22 nt, Human
ugcaguggcacgaucucagcuc

SEQ ID NO: 1376897 - RNA, 25 nt, Human
ugccaguaucucauucuucccuggc

SEQ ID NO: 1376898 - RNA, 19 nt, Human
ugcccaggcugggagugca

SEQ ID NO: 1376899 - RNA, 23 nt, Human
ugccucagccuccugaguagcua

SEQ ID NO: 1376900 - RNA, 24 nt, Human
ugccucagccuccugaguagcuag

SEQ ID NO: 1376901 - RNA, 22 nt, Human
ugcgguaacgccaugcucuuaa

SEQ ID NO: 1376902 - RNA, 24 nt, Human
ugcugggauuacaggcgugagcca

SEQ ID NO: 1376903 - RNA, 18 nt, Human
uggauguagaugucuggg

SEQ ID NO: 1376904 - RNA, 24 nt, Human
uggcacgaucucagcucacugcaa

SEQ ID NO: 1376905 - RNA, 24 nt, Human
uggccaaccuggucucgaacuccu

SEQ ID NO: 1376906 - RNA, 18 nt, Human
ugggauuacaggcgugag

SEQ ID NO: 1376907 - RNA, 19 nt, Human
ugggauuacaggcgugagc

SEQ ID NO: 1376908 - RNA, 21 nt, Human
ugggauuacaggcgugagcca

SEQ ID NO: 1376909 - RNA, 22 nt, Human
ugggauuacaggcgugagccac

SEQ ID NO: 1376910 - RNA, 22 nt, Human
ugggauuacaggcgugagccac

SEQ ID NO: 1376911 - RNA, 23 nt, Human
ugggauuacaggcgugagccacg

SEQ ID NO: 1376912 - RNA, 27 nt, Human
ugggauuacaggcgugagccacgcgcc

SEQ ID NO: 1376913 - RNA, 19 nt, Human
uggggucucaccauguugg

SEQ ID NO: 1376914 - RNA, 23 nt, Human
uggggucucaccauguuggccaa

SEQ ID NO: 1376915 - RNA, 21 nt, Human
uguauuuuuagcagagauggg

SEQ ID NO: 1376916 - RNA, 24 nt, Human
uuagcagagauggggucucaccau

SEQ ID NO: 1376917 - RNA, 21 nt, Human
uucaagcgauucuccugccuc

SEQ ID NO: 1376918 - RNA, 23 nt, Human
uucaagcgauucuccugccucag

SEQ ID NO: 1376919 - RNA, 24 nt, Human
uucaagcgauucuccugccucagc

SEQ ID NO: 1376920 - RNA, 19 nt, Human
uucccacauucaaacacug

SEQ ID NO: 1376921 - RNA, 25 nt, Human
uugcccaggcugggagugcaguggc

SEQ ID NO: 1376922 - RNA, 23 nt, Human
uuguauuuuuagcagagaugggg

SEQ ID NO: 1376923 - RNA, 24 nt, Human
uuuuuagcagagauggggucucac

SEQ ID NO: 1376924 - RNA, 20 nt, Human
uuuuuguauuuuuagcagag

SEQ ID NO: 1376925 - RNA, 23 nt, Human
uuuuuguauuuuuagcagagaug

SEQ ID NO: 1376926 - RNA, 22 nt, Human
aaagaaacugccaccugccccu

SEQ ID NO: 1376927 - RNA, 20 nt, Human
aacagaacguaccaauuaac

SEQ ID NO: 1376928 - RNA, 18 nt, Human
aacaguggagcauccuuc

SEQ ID NO: 1376929 - RNA, 24 nt, Human
aagagcuggcccaaggacucaggg

SEQ ID NO: 1376930 - RNA, 18 nt, Human
aaggacucagggucuggg

SEQ ID NO: 1376931 - RNA, 24 nt, Human
aaggggccuggagauggcagcagg

SEQ ID NO: 1376932 - RNA, 19 nt, Human
acagaacguaccaauuaac

SEQ ID NO: 1376933 - RNA, 24 nt, Human
acauugucuuaauucucaagacaa

SEQ ID NO: 1376934 - RNA, 18 nt, Human
agagaugggguccccacc

SEQ ID NO: 1376935 - RNA, 26 nt, Human
agagaugugcauuuuucacaaacucc

SEQ ID NO: 1376936 - RNA, 19 nt, Human
agagcccuuccugacacac

SEQ ID NO: 1376937 - RNA, 23 nt, Human
aggcaggugggcaaggggcuggg

SEQ ID NO: 1376938 - RNA, 23 nt, Human
aggccagaggcaggugggcaagg

SEQ ID NO: 1376939 - RNA, 22 nt, Human
aggccagggcugaagaggggga

SEQ ID NO: 1376940 - RNA, 21 nt, Human
aggccccagagcucauaggug

SEQ ID NO: 1376941 - RNA, 20 nt, Human
aggcuuugggaggcuaggcc

SEQ ID NO: 1376942 - RNA, 19 nt, Human
agggaggggagacugacag

SEQ ID NO: 1376943 - RNA, 21 nt, Human
aggugguagagcagaggccca

SEQ ID NO: 1376944 - RNA, 21 nt, Human
caccugccccuuuugccccca

SEQ ID NO: 1376945 - RNA, 19 nt, Human
cagaguccuccagcccauc

SEQ ID NO: 1376946 - RNA, 23 nt, Human
cagaguccuccagcccauccucu

SEQ ID NO: 1376947 - RNA, 18 nt, Human
cagcagggggucagcucu

SEQ ID NO: 1376948 - RNA, 22 nt, Human
cagcccagcauuaauccaugcc

SEQ ID NO: 1376949 - RNA, 21 nt, Human
caggaaaggcagggcagcagc

SEQ ID NO: 1376950 - RNA, 19 nt, Human
caggcuuugggaggcuagg

SEQ ID NO: 1376951 - RNA, 22 nt, Human
caugcaugccugccugccuccc

SEQ ID NO: 1376952 - RNA, 23 nt, Human
ccaacauccagaguccuccagcc

SEQ ID NO: 1376953 - RNA, 27 nt, Human
ccaacauccagaguccuccagcccauc

SEQ ID NO: 1376954 - RNA, 28 nt, Human
ccacaugcaugccugccugccucccucc

SEQ ID NO: 1376955 - RNA, 20 nt, Human
ccacccaggagccagaacag

SEQ ID NO: 1376956 - RNA, 20 nt, Human
ccagagcucauaggugguag

SEQ ID NO: 1376957 - RNA, 19 nt, Human
ccagaggcaggugggcaag

SEQ ID NO: 1376958 - RNA, 23 nt, Human
ccaggauugaggaaaaccaguuc

SEQ ID NO: 1376959 - RNA, 22 nt, Human
ccccacccaggagccagaacag

SEQ ID NO: 1376960 - RNA, 19 nt, Human
ccuccagcccauccucugc

SEQ ID NO: 1376961 - RNA, 18 nt, Human
ccucccguccagccugac

SEQ ID NO: 1376962 - RNA, 22 nt, Human
ccuccuggucuuagccaagagc

SEQ ID NO: 1376963 - RNA, 20 nt, Human
ccugcagguaaggggccugg

SEQ ID NO: 1376964 - RNA, 19 nt, Human
cuccccauuggccagcccc

SEQ ID NO: 1376965 - RNA, 21 nt, Human
cuccccauuggccagccccaa

SEQ ID NO: 1376966 - RNA, 20 nt, Human
cugacacacagccggagagg

SEQ ID NO: 1376967 - RNA, 24 nt, Human
cuugcagccuccuggucuuagcca

SEQ ID NO: 1376968 - RNA, 20 nt, Human
gaacagggaguuggggaacc

SEQ ID NO: 1376969 - RNA, 22 nt, Human
gaaccagagucaggcuuuggga

SEQ ID NO: 1376970 - RNA, 22 nt, Human
gagaacaacgggagcaaagagc

SEQ ID NO: 1376971 - RNA, 23 nt, Human
gagccagaacagggaguugggga

SEQ ID NO: 1376972 - RNA, 24 nt, Human
gcccccaggaaaggcagggcagca

SEQ ID NO: 1376973 - RNA, 19 nt, Human
gcuaggccagggcugaaga

SEQ ID NO: 1376974 - RNA, 30 nt, Human
ggaaggccagaggcaggugggcaaggggcc

SEQ ID NO: 1376975 - RNA, 20 nt, Human
ggccccagagcucauaggug

SEQ ID NO: 1376976 - RNA, 18 nt, Human
gggcaaggggcuggguuu

SEQ ID NO: 1376977 - RNA, 23 nt, Human
gggcugaagagggggaggcaaau

SEQ ID NO: 1376978 - RNA, 18 nt, Human
ggggcuggauagccgggg

SEQ ID NO: 1376979 - RNA, 21 nt, Human
gucagcucugcgcaccccucu

SEQ ID NO: 1376980 - RNA, 23 nt, Human
gucagcucugcgcaccccucugg

SEQ ID NO: 1376981 - RNA, 18 nt, Human
gucaggcuuugggaggcu

SEQ ID NO: 1376982 - RNA, 23 nt, Human
gucccugagagauggggucccca

SEQ ID NO: 1376983 - RNA, 18 nt, Human
guggagcauccuucagaa

SEQ ID NO: 1376984 - RNA, 23 nt, Human
guuguucccuucuagguccaagg

SEQ ID NO: 1376985 - RNA, 22 nt, Human
uaaauaacucgugucaggcccc

SEQ ID NO: 1376986 - RNA, 22 nt, Human
uaacaacagaacguaccaauua

SEQ ID NO: 1376987 - RNA, 25 nt, Human
uaaggggccuggagauggcagcagg

SEQ ID NO: 1376988 - RNA, 23 nt, Human
ucagaacacgauaucugagucag

SEQ ID NO: 1376989 - RNA, 22 nt, Human
ucccaaaggugacggcaaugcc

SEQ ID NO: 1376990 - RNA, 21 nt, Human
ucccugcagguaaggggccug

SEQ ID NO: 1376991 - RNA, 21 nt, Human
uccuaaccugaaccaagaggu

SEQ ID NO: 1376992 - RNA, 22 nt, Human
uccuucagaacacgauaucuga

SEQ ID NO: 1376993 - RNA, 28 nt, Human
ucugaggcugaaaaagaaaccggggucc

SEQ ID NO: 1376994 - RNA, 23 nt, Human
ugacacacagccggagaggccag

SEQ ID NO: 1376995 - RNA, 21 nt, Human
ugacucagcaggucugggcag

SEQ ID NO: 1376996 - RNA, 18 nt, Human
ugagagauggggucccca

SEQ ID NO: 1376997 - RNA, 21 nt, Human
ugaggaaaaccaguucugagg

SEQ ID NO: 1376998 - RNA, 18 nt, Human
ugaguagcaagggguuca

SEQ ID NO: 1376999 - RNA, 23 nt, Human
ugccgauuguccauggacuacac

SEQ ID NO: 1377000 - RNA, 18 nt, Human
uggauagccgggggucgu

SEQ ID NO: 1377001 - RNA, 21 nt, Human
ugggagcugggagggucccug

SEQ ID NO: 1377002 - RNA, 19 nt, Human
ugggcaaaggucaugauug

SEQ ID NO: 1377003 - RNA, 21 nt, Human
uuaacugaccguguacugggu

SEQ ID NO: 1377004 - RNA, 18 nt, Human
aaaagggagugaggcaca

SEQ ID NO: 1377005 - RNA, 19 nt, Human
aaaagggagugaggcacag

SEQ ID NO: 1377006 - RNA, 21 nt, Human
aaacagcuauaaauuaaccua

SEQ ID NO: 1377007 - RNA, 24 nt, Human
aaagugcugagacuacaggccugg

SEQ ID NO: 1377008 - RNA, 20 nt, Human
aacaugagaaaagucaccau

SEQ ID NO: 1377009 - RNA, 27 nt, Human
aacccacagcuacaaaaaaggaaaguc

SEQ ID NO: 1377010 - RNA, 19 nt, Human
aagugcugagacuacaggc

SEQ ID NO: 1377011 - RNA, 18 nt, Human
acagugugaaccaggggu

SEQ ID NO: 1377012 - RNA, 18 nt, Human
acagugugaaccaggggu

SEQ ID NO: 1377013 - RNA, 24 nt, Human
accaggaguucaugggaauucuuc

SEQ ID NO: 1377014 - RNA, 24 nt, Human
accagggguucaugggaauucuuc

SEQ ID NO: 1377015 - RNA, 24 nt, Human
accagggguucaugggaauucuuc

SEQ ID NO: 1377016 - RNA, 25 nt, Human
acccacacucaauagcugaacaaca

SEQ ID NO: 1377017 - RNA, 22 nt, Human
acguaaauuccagacaaacgua

SEQ ID NO: 1377018 - RNA, 21 nt, Human
agaaacugaaaaacugugacu

SEQ ID NO: 1377019 - RNA, 22 nt, Human
agaaagcagcagagauagucaa

SEQ ID NO: 1377020 - RNA, 25 nt, Human
agaaggcagaggugaggccugcaaa

SEQ ID NO: 1377021 - RNA, 19 nt, Human
agaauaggcucagagagac

SEQ ID NO: 1377022 - RNA, 24 nt, Human
agacaaacguagaaaguggcuccu

SEQ ID NO: 1377023 - RNA, 23 nt, Human
agagauagucaaaaacccacagc

SEQ ID NO: 1377024 - RNA, 26 nt, Human
aggacaaagauacauaguaaaaaaaa

SEQ ID NO: 1377025 - RNA, 20 nt, Human
agggagugaggcacagaagg

SEQ ID NO: 1377026 - RNA, 22 nt, Human
aggugaggccugcaaacagcag

SEQ ID NO: 1377027 - RNA, 26 nt, Human
aguguccacacauccaauuagaugac

SEQ ID NO: 1377028 - RNA, 21 nt, Human
auuucuguaaaccagugagaa

SEQ ID NO: 1377029 - RNA, 23 nt, Human
caaaaaaugcacuccuaagagca

SEQ ID NO: 1377030 - RNA, 24 nt, Human
caaaaaaugcacuccuaagagcaa

SEQ ID NO: 1377031 - RNA, 24 nt, Human
caaagugcugagacuacaggccug

SEQ ID NO: 1377032 - RNA, 23 nt, Human
caaguuccuauuaguccacuccc

SEQ ID NO: 1377033 - RNA, 19 nt, Human
cacugugccccuucugggc

SEQ ID NO: 1377034 - RNA, 19 nt, Human
cacuguguggccaaagacu

SEQ ID NO: 1377035 - RNA, 19 nt, Human
cacuguguggccaaagacu

SEQ ID NO: 1377036 - RNA, 21 nt, Human
cagcuacaaaaaaugcacucc

SEQ ID NO: 1377037 - RNA, 19 nt, Human
caggccagccugggccugc

SEQ ID NO: 1377038 - RNA, 25 nt, Human
caggccgagagagacauucaaauga

SEQ ID NO: 1377039 - RNA, 24 nt, Human
cauaaaggcucucucgugagcacc

SEQ ID NO: 1377040 - RNA, 21 nt, Human
cauccaauuagaugacuguuc

SEQ ID NO: 1377041 - RNA, 20 nt, Human
ccaaagugcugagacuacag

SEQ ID NO: 1377042 - RNA, 21 nt, Human
ccacacauccaauuagaugac

SEQ ID NO: 1377043 - RNA, 23 nt, Human
ccacacucaauagcugaacaaca

SEQ ID NO: 1377044 - RNA, 20 nt, Human
ccacagccucccgaagugcu

SEQ ID NO: 1377045 - RNA, 20 nt, Human
ccacagcuacaaaaaaugca

SEQ ID NO: 1377046 - RNA, 19 nt, Human
ccagagcggucuggcucag

SEQ ID NO: 1377047 - RNA, 21 nt, Human
ccaggcucaggugauccgccc

SEQ ID NO: 1377048 - RNA, 22 nt, Human
ccagugccacuguguggccaaa

SEQ ID NO: 1377049 - RNA, 18 nt, Human
cccaaauaaacucucuac

SEQ ID NO: 1377050 - RNA, 25 nt, Human
cccaaauaaacucucuacuuagaga

SEQ ID NO: 1377051 - RNA, 21 nt, Human
cccacaauccccauuuuuuaa

SEQ ID NO: 1377052 - RNA, 18 nt, Human
cccaggcucaggugaucc

SEQ ID NO: 1377053 - RNA, 24 nt, Human
ccgccacagccucccgaagugcug

SEQ ID NO: 1377054 - RNA, 21 nt, Human
cgaagugcugagccucccaaa

SEQ ID NO: 1377055 - RNA, 23 nt, Human
cggucuggcucaggccagccugg

SEQ ID NO: 1377056 - RNA, 21 nt, Human
cucccaaagugcugagacuac

SEQ ID NO: 1377057 - RNA, 21 nt, Human
cugagccucccaaagugcuga

SEQ ID NO: 1377058 - RNA, 19 nt, Human
cuggccgcccgcccgccag

SEQ ID NO: 1377059 - RNA, 24 nt, Human
cugggccugccgaguagcugggac

SEQ ID NO: 1377060 - RNA, 22 nt, Human
gaauaggcucagagagacucca

SEQ ID NO: 1377061 - RNA, 23 nt, Human
gccacagccucccgaagugcuga

SEQ ID NO: 1377062 - RNA, 20 nt, Human
ggaauucuucaccauccagu

SEQ ID NO: 1377063 - RNA, 20 nt, Human
ggaauucuucaccauccagu

SEQ ID NO: 1377064 - RNA, 20 nt, Human
ggaauucuucaucauccagu

SEQ ID NO: 1377065 - RNA, 19 nt, Human
ggacagaaaagggagugag

SEQ ID NO: 1377066 - RNA, 25 nt, Human
gggaauucuucaccauccagugguc

SEQ ID NO: 1377067 - RNA, 25 nt, Human
gggaauucuucaucauccagugguc

SEQ ID NO: 1377068 - RNA, 21 nt, Human
ggggggaaaagcaaauacagg

SEQ ID NO: 1377069 - RNA, 19 nt, Human
gugaggcacagaaggcaga

SEQ ID NO: 1377070 - RNA, 20 nt, Human
gugaggccugcaaacagcag

SEQ ID NO: 1377071 - RNA, 24 nt, Human
gugauccgcccgccacagccuccc

SEQ ID NO: 1377072 - RNA, 19 nt, Human
gugcugagccucccaaagu

SEQ ID NO: 1377073 - RNA, 23 nt, Human
gugcugagccucccaaagugcug

SEQ ID NO: 1377074 - RNA, 18 nt, Human
uaaaaggcacugugcccc

SEQ ID NO: 1377075 - RNA, 20 nt, Human
uaacaugagaaaagucacca

SEQ ID NO: 1377076 - RNA, 23 nt, Human
uaaccuaaugacgccacaaugga

SEQ ID NO: 1377077 - RNA, 19 nt, Human
uaaggcugaaaaaauuaaa

SEQ ID NO: 1377078 - RNA, 18 nt, Human
uaauuaccacauuuaaau

SEQ ID NO: 1377079 - RNA, 19 nt, Human
uacaguguccacacaucca

SEQ ID NO: 1377080 - RNA, 18 nt, Human
uacaguuggaaccaggag

SEQ ID NO: 1377081 - RNA, 24 nt, Human
uacguugcgcaggcuggucuccaa

SEQ ID NO: 1377082 - RNA, 22 nt, Human
uagagauagggucuugcuacgu

SEQ ID NO: 1377083 - RNA, 24 nt, Human
uagggucuugcuacguugcgcagg

SEQ ID NO: 1377084 - RNA, 24 nt, Human
uaguaaaaaaaaaauucuggcagg

SEQ ID NO: 1377085 - RNA, 22 nt, Human
ucaccauauaaaagugaggggg

SEQ ID NO: 1377086 - RNA, 22 nt, Human
ucagggcgccuugaauuugugc

SEQ ID NO: 1377087 - RNA, 20 nt, Human
uccaguagucuguaaauguu

SEQ ID NO: 1377088 - RNA, 20 nt, Human
uccaguggucuguaaauguu

SEQ ID NO: 1377089 - RNA, 24 nt, Human
ucccaaagugcugagacuacaggc

SEQ ID NO: 1377090 - RNA, 18 nt, Human
ucccaggcucaggugauc

SEQ ID NO: 1377091 - RNA, 20 nt, Human
ucccaggcucaggugauccg

SEQ ID NO: 1377092 - RNA, 21 nt, Human
uccgcccgccacagccucccg

SEQ ID NO: 1377093 - RNA, 20 nt, Human
uccucacaaacaaguuccua

SEQ ID NO: 1377094 - RNA, 21 nt, Human
ucgcgcccuacuaccccuuga

SEQ ID NO: 1377095 - RNA, 26 nt, Human
ucggaguacacauucagggcgccuug

SEQ ID NO: 1377096 - RNA, 20 nt, Human
ucuggcagguauuaaggcug

SEQ ID NO: 1377097 - RNA, 23 nt, Human
ucuugcuacguugcgcaggcugg

SEQ ID NO: 1377098 - RNA, 24 nt, Human
ucuugcuacguugcgcaggcuggu

SEQ ID NO: 1377099 - RNA, 21 nt, Human
ugaaucuguuuuagagauagg

SEQ ID NO: 1377100 - RNA, 18 nt, Human
ugacugauucaagaguag

SEQ ID NO: 1377101 - RNA, 23 nt, Human
ugagaaaagucaccauauaaaag

SEQ ID NO: 1377102 - RNA, 19 nt, Human
ugagacuacaggccuggcc

SEQ ID NO: 1377103 - RNA, 19 nt, Human
ugagacuacaggccuggcc

SEQ ID NO: 1377104 - RNA, 21 nt, Human
ugagcaccgcacguuuucccu

SEQ ID NO: 1377105 - RNA, 24 nt, Human
ugcccaugcugaguagucuguccu

SEQ ID NO: 1377106 - RNA, 24 nt, Human
ugcuacguugcgcaggcuggucuc

SEQ ID NO: 1377107 - RNA, 23 nt, Human
uggacacuauacccacacucaau

SEQ ID NO: 1377108 - RNA, 19 nt, Human
uggcaacagcgccacaaac

SEQ ID NO: 1377109 - RNA, 22 nt, Human
uggcuacagcucgugucuggcu

SEQ ID NO: 1377110 - RNA, 20 nt, Human
ugguuuugagaaaagagaau

SEQ ID NO: 1377111 - RNA, 28 nt, Human
ugugacugcuggagccauuuucccacaa

SEQ ID NO: 1377112 - RNA, 24 nt, Human
uguugcccaugcuuuaguuuuguu

SEQ ID NO: 1377113 - RNA, 18 nt, Human
uuaguccacucccuggcc

SEQ ID NO: 1377114 - RNA, 18 nt, Human
uuuaaacugcuacuggug

SEQ ID NO: 1377115 - RNA, 23 nt, Human
aaaaaaucagaacugagcauugc

SEQ ID NO: 1377116 - RNA, 22 nt, Human
acgcuguccucaucauccuccc

SEQ ID NO: 1377117 - RNA, 18 nt, Human
acgugagugguuucuuuc

SEQ ID NO: 1377118 - RNA, 19 nt, Human
acugccuccucugcaccgg

SEQ ID NO: 1377119 - RNA, 21 nt, Human
agaagcguguccuauguucau

SEQ ID NO: 1377120 - RNA, 23 nt, Human
agaagcguguccuauguucaugg

SEQ ID NO: 1377121 - RNA, 19 nt, Human
agccaaggccgaguccucc

SEQ ID NO: 1377122 - RNA, 19 nt, Human
agccugugaugaacacugc

SEQ ID NO: 1377123 - RNA, 21 nt, Human
agggcgcugagcaacagaaaa

SEQ ID NO: 1377124 - RNA, 21 nt, Human
agugcuuuuccaagcucaccu

SEQ ID NO: 1377125 - RNA, 21 nt, Human
augguucucccccuccuugcc

SEQ ID NO: 1377126 - RNA, 22 nt, Human
caaauacauuaagugaaacacc

SEQ ID NO: 1377127 - RNA, 19 nt, Human
cagugagcuuguccuuguu

SEQ ID NO: 1377128 - RNA, 19 nt, Human
caguguucucagauuuucc

SEQ ID NO: 1377129 - RNA, 23 nt, Human
cauuuuggcucugccccucugga

SEQ ID NO: 1377130 - RNA, 22 nt, Human
ccagcgucugccggcuucucuc

SEQ ID NO: 1377131 - RNA, 22 nt, Human
cccgcacccugcucccugcuuc

SEQ ID NO: 1377132 - RNA, 18 nt, Human
cccugagcccuaugcuaa

SEQ ID NO: 1377133 - RNA, 18 nt, Human
ccgcacccugcucccugc

SEQ ID NO: 1377134 - RNA, 21 nt, Human
ccgcacccugcucccugcuuc

SEQ ID NO: 1377135 - RNA, 21 nt, Human
ccuccuugccuccucccuacu

SEQ ID NO: 1377136 - RNA, 18 nt, Human
ccucuacagacagaagcg

SEQ ID NO: 1377137 - RNA, 19 nt, Human
ccuuaugcuugguaccucc

SEQ ID NO: 1377138 - RNA, 22 nt, Human
cggcuucucuccagcagcucca

SEQ ID NO: 1377139 - RNA, 26 nt, Human
cucaaaacauuaaaaaaaaaaaaauc

SEQ ID NO: 1377140 - RNA, 18 nt, Human
cuccagcagcuccagccc

SEQ ID NO: 1377141 - RNA, 20 nt, Human
cuccagcagcuccagccucc

SEQ ID NO: 1377142 - RNA, 21 nt, Human
cuccucccuacuccaccucug

SEQ ID NO: 1377143 - RNA, 21 nt, Human
cuccuuguucucacugcccac

SEQ ID NO: 1377144 - RNA, 21 nt, Human
cucucuagccugugaugaaca

SEQ ID NO: 1377145 - RNA, 20 nt, Human
cucugcaccgggcucaccgc

SEQ ID NO: 1377146 - RNA, 23 nt, Human
cugacgucggagggguucuucuc

SEQ ID NO: 1377147 - RNA, 18 nt, Human
cugagcuccaccaccucc

SEQ ID NO: 1377148 - RNA, 19 nt, Human
cugccccucuggaagaucc

SEQ ID NO: 1377149 - RNA, 19 nt, Human
cugccccucuggaagaucc

SEQ ID NO: 1377150 - RNA, 22 nt, Human
cugcuucugagcuccugucugc

SEQ ID NO: 1377151 - RNA, 18 nt, Human
gaaacaccaaagcuuaga

SEQ ID NO: 1377152 - RNA, 19 nt, Human
ggcuucucuccagcagcuc

SEQ ID NO: 1377153 - RNA, 19 nt, Human
gucucauaugaagccucua

SEQ ID NO: 1377154 - RNA, 20 nt, Human
guucucagauuuuccccagc

SEQ ID NO: 1377155 - RNA, 23 nt, Human
ucaaaacauuaaaaaaaaaaaaa

SEQ ID NO: 1377156 - RNA, 19 nt, Human
ucacugcccaccuucuucu

SEQ ID NO: 1377157 - RNA, 23 nt, Human
ucagagcccacgcuguccucauc

SEQ ID NO: 1377158 - RNA, 20 nt, Human
ucaucauccucccgcacccu

SEQ ID NO: 1377159 - RNA, 23 nt, Human
uccaucuuuccagggcagugagc

SEQ ID NO: 1377160 - RNA, 20 nt, Human
ucccugcuucugagcuccug

SEQ ID NO: 1377161 - RNA, 24 nt, Human
uccguugucucuucuuagccaagg

SEQ ID NO: 1377162 - RNA, 22 nt, Human
ucucauuuuggcucugccccuc

SEQ ID NO: 1377163 - RNA, 18 nt, Human
ucuccuccagcgucugcc

SEQ ID NO: 1377164 - RNA, 24 nt, Human
ucucuguauccucauccugcgaug

SEQ ID NO: 1377165 - RNA, 18 nt, Human
ucugagcuccugucugcc

SEQ ID NO: 1377166 - RNA, 22 nt, Human
ugaaacaccaaagcuuagaggg

SEQ ID NO: 1377167 - RNA, 18 nt, Human
ugagugguggcaacgugu

SEQ ID NO: 1377168 - RNA, 20 nt, Human
ugaugaacacugccaaauac

SEQ ID NO: 1377169 - RNA, 18 nt, Human
ugccaggagaggucagac

SEQ ID NO: 1377170 - RNA, 22 nt, Human
ugccaggagaggucagacuugc

SEQ ID NO: 1377171 - RNA, 19 nt, Human
ugcccaccuucuucuggug

SEQ ID NO: 1377172 - RNA, 21 nt, Human
ugcccugagcccuaugcuaac

SEQ ID NO: 1377173 - RNA, 22 nt, Human
uucaguguucucagauuuuccc

SEQ ID NO: 1377174 - RNA, 24 nt, Human
uucaguguucucagauuuucccca

SEQ ID NO: 1377175 - RNA, 20 nt, Human
uuccaucuuuccagggcagu

SEQ ID NO: 1377176 - RNA, 21 nt, Human
uucguauugaugguucucccc

SEQ ID NO: 1377177 - RNA, 23 nt, Human
uucucacugcccaccuucuucug

SEQ ID NO: 1377178 - RNA, 24 nt, Human
uucucccccuccuugccuccuccc

SEQ ID NO: 1377179 - RNA, 19 nt, Human
uucugagcuccugucugcc

SEQ ID NO: 1377180 - RNA, 22 nt, Human
uucugguguuucagcuuccagg

SEQ ID NO: 1377181 - RNA, 18 nt, Human
uuggcucugccccucugg

SEQ ID NO: 1377182 - RNA, 23 nt, Human
uugguaccucucauuuuggcucu

SEQ ID NO: 1377183 - RNA, 21 nt, Human
aaagaccagggugcaaguucc

SEQ ID NO: 1377184 - RNA, 23 nt, Human
aaccugucccaccauuguggcgu

SEQ ID NO: 1377185 - RNA, 22 nt, Human
aagcagagaaggcaaaaggaga

SEQ ID NO: 1377186 - RNA, 27 nt, Human
acaccaggccccccaccacccgcugga

SEQ ID NO: 1377187 - RNA, 22 nt, Human
accugcggagaggggguaccag

SEQ ID NO: 1377188 - RNA, 19 nt, Human
acgaacugcgauaugaaca

SEQ ID NO: 1377189 - RNA, 19 nt, Human
acuguguccauguaaguag

SEQ ID NO: 1377190 - RNA, 20 nt, Human
agaaaaaggagauuugugua

SEQ ID NO: 1377191 - RNA, 23 nt, Human
agacuggaaccaggguugcagga

SEQ ID NO: 1377192 - RNA, 22 nt, Human
agauagaggcuucuacagaaau

SEQ ID NO: 1377193 - RNA, 26 nt, Human
agaugaugcuguguugguuuguaugg

SEQ ID NO: 1377194 - RNA, 19 nt, Human
agcuuccgaaugguuuccu

SEQ ID NO: 1377195 - RNA, 23 nt, Human
aggggucugcaaaauagugcagu

SEQ ID NO: 1377196 - RNA, 24 nt, Human
aggguugcaggaccacgcagucac

SEQ ID NO: 1377197 - RNA, 21 nt, Human
agugccuuucggaugggugac

SEQ ID NO: 1377198 - RNA, 20 nt, Human
aucuggcugcuuccugcugg

SEQ ID NO: 1377199 - RNA, 21 nt, Human
auggaagugugcauaucuucu

SEQ ID NO: 1377200 - RNA, 21 nt, Human
auuguugugaaaauggggugg

SEQ ID NO: 1377201 - RNA, 18 nt, Human
caaaaggagaaaaaggag

SEQ ID NO: 1377202 - RNA, 20 nt, Human
caaaauagugcaguuugggc

SEQ ID NO: 1377203 - RNA, 22 nt, Human
cacaccaggccccccaccaccc

SEQ ID NO: 1377204 - RNA, 18 nt, Human
cacagcucaggcccuggu

SEQ ID NO: 1377205 - RNA, 24 nt, Human
cacagcucaggcccugguggaauu

SEQ ID NO: 1377206 - RNA, 26 nt, Human
cagaagcuauuaggugaaggagggca

SEQ ID NO: 1377207 - RNA, 21 nt, Human
cagcagccaggucuacaaugc

SEQ ID NO: 1377208 - RNA, 19 nt, Human
cagcggacccugggccccg

SEQ ID NO: 1377209 - RNA, 19 nt, Human
cagcuagugccagagcccc

SEQ ID NO: 1377210 - RNA, 20 nt, Human
cagcucaggucagguuccgg

SEQ ID NO: 1377211 - RNA, 24 nt, Human
cagggguccuaggaagggggcaac

SEQ ID NO: 1377212 - RNA, 21 nt, Human
ccagcacaccaggccccccac

SEQ ID NO: 1377213 - RNA, 20 nt, Human
ccagugccaagugcagcagu

SEQ ID NO: 1377214 - RNA, 24 nt, Human
ccauaagcagagaaggcaaaagga

SEQ ID NO: 1377215 - RNA, 21 nt, Human
ccauccaacugcaugucacuc

SEQ ID NO: 1377216 - RNA, 23 nt, Human
cccaccacccgcuggaagcacag

SEQ ID NO: 1377217 - RNA, 21 nt, Human
ccccagcucaggucagguucc

SEQ ID NO: 1377218 - RNA, 20 nt, Human
cccgcuggaagcacaggccc

SEQ ID NO: 1377219 - RNA, 20 nt, Human
ccuggauaaaacaauucagc

SEQ ID NO: 1377220 - RNA, 22 nt, Human
ccuucugccaggcagaggugga

SEQ ID NO: 1377221 - RNA, 20 nt, Human
ccuucugccaggcagagguu

SEQ ID NO: 1377222 - RNA, 19 nt, Human
cggaugggugacuucugga

SEQ ID NO: 1377223 - RNA, 18 nt, Human
cggucugaacucuuggcc

SEQ ID NO: 1377224 - RNA, 23 nt, Human
cugaaaccaugcugagagagcug

SEQ ID NO: 1377225 - RNA, 19 nt, Human
gacuuaauacguggugugu

SEQ ID NO: 1377226 - RNA, 20 nt, Human
gagccugaaagaccagggug

SEQ ID NO: 1377227 - RNA, 21 nt, Human
gagcuuccgaaugguuuccuc

SEQ ID NO: 1377228 - RNA, 20 nt, Human
gagguccaggacucuccagu

SEQ ID NO: 1377229 - RNA, 23 nt, Human
gagguggugauggcggugggggc

SEQ ID NO: 1377230 - RNA, 21 nt, Human
gauuaggguagguucggcuga

SEQ ID NO: 1377231 - RNA, 23 nt, Human
gcaggaccacgcagucaccgcca

SEQ ID NO: 1377232 - RNA, 21 nt, Human
gcaguuugggcuaacauucuu

SEQ ID NO: 1377233 - RNA, 18 nt, Human
gccccagcucaggucagg

SEQ ID NO: 1377234 - RNA, 19 nt, Human
gccccagcucaggucaggu

SEQ ID NO: 1377235 - RNA, 20 nt, Human
gcuugccagacuggaaccag

SEQ ID NO: 1377236 - RNA, 18 nt, Human
ggagaggggguaccagcu

SEQ ID NO: 1377237 - RNA, 22 nt, Human
ggccccgucagucuucagcagc

SEQ ID NO: 1377238 - RNA, 18 nt, Human
ggcggugggggcagcgga

SEQ ID NO: 1377239 - RNA, 22 nt, Human
gggcaggagaggucugggauug

SEQ ID NO: 1377240 - RNA, 23 nt, Human
gggcguugugauuagggccuggg

SEQ ID NO: 1377241 - RNA, 18 nt, Human
ggggaagggguaccagga

SEQ ID NO: 1377242 - RNA, 24 nt, Human
ggggcccagcugucagugauuggg

SEQ ID NO: 1377243 - RNA, 18 nt, Human
ggggguggggacucagaa

SEQ ID NO: 1377244 - RNA, 24 nt, Human
ggguggggauaugaaggaaguuug

SEQ ID NO: 1377245 - RNA, 20 nt, Human
gguucuggagcuuccgaaug

SEQ ID NO: 1377246 - RNA, 21 nt, Human
gugaaggagggcaacagcccu

SEQ ID NO: 1377247 - RNA, 18 nt, Human
guggggauaugaaggaag

SEQ ID NO: 1377248 - RNA, 19 nt, Human
guuagaggagaggggagau

SEQ ID NO: 1377249 - RNA, 19 nt, Human
guuccgagguggugauggc

SEQ ID NO: 1377250 - RNA, 23 nt, Human
uacccuggguuccgaggugguga

SEQ ID NO: 1377251 - RNA, 21 nt, Human
uagaaaggguugugaauagug

SEQ ID NO: 1377252 - RNA, 21 nt, Human
uagggccuggguucuggagcu

SEQ ID NO: 1377253 - RNA, 20 nt, Human
ucagccaagaaugguauagc

SEQ ID NO: 1377254 - RNA, 19 nt, Human
ucagugauugggggugggg

SEQ ID NO: 1377255 - RNA, 23 nt, Human
ucagugguuaggagguccaggac

SEQ ID NO: 1377256 - RNA, 23 nt, Human
ucccgggcaggagaggucuggga

SEQ ID NO: 1377257 - RNA, 23 nt, Human
uccuugccaccaggagucagcga

SEQ ID NO: 1377258 - RNA, 22 nt, Human
ucuuggccacaagaucuaagcc

SEQ ID NO: 1377259 - RNA, 19 nt, Human
ugaaauccuggaaggugcc

SEQ ID NO: 1377260 - RNA, 19 nt, Human
ugaagaggagauagaggcu

SEQ ID NO: 1377261 - RNA, 20 nt, Human
ugaagccuacgaacugcgau

SEQ ID NO: 1377262 - RNA, 18 nt, Human
ugacagcguuacccuggg

SEQ ID NO: 1377263 - RNA, 22 nt, Human
ugacagcguuacccuggguucc

SEQ ID NO: 1377264 - RNA, 21 nt, Human
ugacuuaauacguggugugug

SEQ ID NO: 1377265 - RNA, 18 nt, Human
ugaggugguuaugccugc

SEQ ID NO: 1377266 - RNA, 21 nt, Human
ugaguuugaaggaaagguguu

SEQ ID NO: 1377267 - RNA, 23 nt, Human
ugcagccagggguuaggccuggg

SEQ ID NO: 1377268 - RNA, 20 nt, Human
ugccagacuggaaccagggu

SEQ ID NO: 1377269 - RNA, 25 nt, Human
ugccuuucggaugggugacuucugg

SEQ ID NO: 1377270 - RNA, 23 nt, Human
uggaagugugcauaucuucuacg

SEQ ID NO: 1377271 - RNA, 23 nt, Human
uggcggugggggcagcggacccu

SEQ ID NO: 1377272 - RNA, 21 nt, Human
uggcgugggcuggauuagggu

SEQ ID NO: 1377273 - RNA, 19 nt, Human
ugggaccugccugacagga

SEQ ID NO: 1377274 - RNA, 18 nt, Human
ugggggcgguguguuugg

SEQ ID NO: 1377275 - RNA, 26 nt, Human
uggggugggggcgguguguuuggcug

SEQ ID NO: 1377276 - RNA, 22 nt, Human
ugguaauggaagugugcauauc

SEQ ID NO: 1377277 - RNA, 20 nt, Human
ugucaaagcucugcagcccu

SEQ ID NO: 1377278 - RNA, 21 nt, Human
ugucaugaagccuacgaacug

SEQ ID NO: 1377279 - RNA, 25 nt, Human
ugugaaaauggggugggggcggugu

SEQ ID NO: 1377280 - RNA, 23 nt, Human
uguguccauguaaguaggucagc

SEQ ID NO: 1377281 - RNA, 18 nt, Human
uucaggaaugaaucagcc

SEQ ID NO: 1377282 - RNA, 30 nt, Human
uucccgcuuacaggcuggaccaguuacagg

SEQ ID NO: 1377283 - RNA, 19 nt, Human
uugaaggaugacucccacg

SEQ ID NO: 1377284 - RNA, 22 nt, Human
uugaugccagcacaccaggccc

SEQ ID NO: 1377285 - RNA, 22 nt, Human
uugcaggaccacgcagucaccg

SEQ ID NO: 1377286 - RNA, 18 nt, Human
uuggaaguggagaguguc

SEQ ID NO: 1377287 - RNA, 22 nt, Human
aaagagaaaacggugaacuuaa

SEQ ID NO: 1377288 - RNA, 24 nt, Human
aaagugcugggauuacagguguga

SEQ ID NO: 1377289 - RNA, 21 nt, Human
aagggguuucaccauauuggu

SEQ ID NO: 1377290 - RNA, 24 nt, Human
aagggguuucaccauauuggucag

SEQ ID NO: 1377291 - RNA, 18 nt, Human
aagugcugggauuacagg

SEQ ID NO: 1377292 - RNA, 19 nt, Human
aagugcugggauuacaggu

SEQ ID NO: 1377293 - RNA, 26 nt, Human
aagugcugggauuacaggugugagcc

SEQ ID NO: 1377294 - RNA, 21 nt, Human
aauauggugaaaccccaucuc

SEQ ID NO: 1377295 - RNA, 24 nt, Human
aaucgcuugaacccgggaggugga

SEQ ID NO: 1377296 - RNA, 23 nt, Human
accauauuggucaggcuggucuc

SEQ ID NO: 1377297 - RNA, 24 nt, Human
accccaucucuacuaaaaauacaa

SEQ ID NO: 1377298 - RNA, 23 nt, Human
acccugugaacccugugaaauga

SEQ ID NO: 1377299 - RNA, 18 nt, Human
accuagcacuuugggagg

SEQ ID NO: 1377300 - RNA, 21 nt, Human
accuagcacuuugggaggcca

SEQ ID NO: 1377301 - RNA, 20 nt, Human
acggcacuccagccuggggg

SEQ ID NO: 1377302 - RNA, 24 nt, Human
acggcacuccagccugggggacgg

SEQ ID NO: 1377303 - RNA, 22 nt, Human
acuccagccugggggacgguga

SEQ ID NO: 1377304 - RNA, 23 nt, Human
acuccagggaguguucguugagg

SEQ ID NO: 1377305 - RNA, 18 nt, Human
acuccuaaaucaacaccu

SEQ ID NO: 1377306 - RNA, 24 nt, Human
acuugaggucaggaguuugagacc

SEQ ID NO: 1377307 - RNA, 23 nt, Human
agcacuuugggaggccaaggcag

SEQ ID NO: 1377308 - RNA, 19 nt, Human
agccuggccaauaugguga

SEQ ID NO: 1377309 - RNA, 22 nt, Human
agccuggccaauauggugaaac

SEQ ID NO: 1377310 - RNA, 24 nt, Human
agccuggccaauauggugaaaccc

SEQ ID NO: 1377311 - RNA, 22 nt, Human
agccugggggacggugagacuc

SEQ ID NO: 1377312 - RNA, 23 nt, Human
agcuggguguggugucaggugcc

SEQ ID NO: 1377313 - RNA, 23 nt, Human
agcuuccugugcuaguggcaagu

SEQ ID NO: 1377314 - RNA, 20 nt, Human
aggaguuugagaccagccug

SEQ ID NO: 1377315 - RNA, 24 nt, Human
aggcaggagaaucgcuugaacccg

SEQ ID NO: 1377316 - RNA, 18 nt, Human
aggcaggcggaucacuug

SEQ ID NO: 1377317 - RNA, 26 nt, Human
aggcaggcggaucacuugaggucagg

SEQ ID NO: 1377318 - RNA, 20 nt, Human
aggcugaggcaggagaaucg

SEQ ID NO: 1377319 - RNA, 24 nt, Human
aggcugaggcaggagaaucgcuug

SEQ ID NO: 1377320 - RNA, 20 nt, Human
agggcacagcgcagccaggc

SEQ ID NO: 1377321 - RNA, 24 nt, Human
agguggagguugcagugagcugag

SEQ ID NO: 1377322 - RNA, 24 nt, Human
agugcaauggugucaucuuggcuc

SEQ ID NO: 1377323 - RNA, 20 nt, Human
agugcugggauuacaggugu

SEQ ID NO: 1377324 - RNA, 24 nt, Human
aguuacaggcaugcaccaccaugc

SEQ ID NO: 1377325 - RNA, 24 nt, Human
aucacgccacggcacuccagccug

SEQ ID NO: 1377326 - RNA, 19 nt, Human
augccuguaaaccuagcac

SEQ ID NO: 1377327 - RNA, 20 nt, Human
auggugaaaccccaucucua

SEQ ID NO: 1377328 - RNA, 24 nt, Human
caaagugcugggauuacaggugug

SEQ ID NO: 1377329 - RNA, 22 nt, Human
caagcgauucuccugccucagc

SEQ ID NO: 1377330 - RNA, 28 nt, Human
caagcgauucuccugccucagcauccca

SEQ ID NO: 1377331 - RNA, 26 nt, Human
caaggcacacauucugacauuaacuu

SEQ ID NO: 1377332 - RNA, 24 nt, Human
caaggcaggcggaucacuugaggu

SEQ ID NO: 1377333 - RNA, 26 nt, Human
caaggcaggcggaucacuugagguca

SEQ ID NO: 1377334 - RNA, 24 nt, Human
caauauggugaaaccccaucucua

SEQ ID NO: 1377335 - RNA, 21 nt, Human
cacaccccugcagauaaacac

SEQ ID NO: 1377336 - RNA, 21 nt, Human
cacagcgcagccaggcgcggc

SEQ ID NO: 1377337 - RNA, 22 nt, Human
caccaccaugccuggcuaauuu

SEQ ID NO: 1377338 - RNA, 21 nt, Human
caccauauuggucaggcuggu

SEQ ID NO: 1377339 - RNA, 24 nt, Human
caccauauuggucaggcuggucuc

SEQ ID NO: 1377340 - RNA, 22 nt, Human
cacggcacuccagccuggggga

SEQ ID NO: 1377341 - RNA, 23 nt, Human
cacggcacuccagccugggggac

SEQ ID NO: 1377342 - RNA, 21 nt, Human
cacuccagccugggggacggu

SEQ ID NO: 1377343 - RNA, 22 nt, Human
cacuccuuccaaauaacacucc

SEQ ID NO: 1377344 - RNA, 23 nt, Human
cacuugaggucaggaguuugaga

SEQ ID NO: 1377345 - RNA, 22 nt, Human
cagauaaacacagaagucacca

SEQ ID NO: 1377346 - RNA, 23 nt, Human
cagauaaacacagaagucaccau

SEQ ID NO: 1377347 - RNA, 23 nt, Human
cagcgcagccaggcgcggcccca

SEQ ID NO: 1377348 - RNA, 24 nt, Human
cagcuacucgggaggcugaggcag

SEQ ID NO: 1377349 - RNA, 26 nt, Human
caggugacccacccaacuuggugucc

SEQ ID NO: 1377350 - RNA, 23 nt, Human
cauagaaagagaaaacggugaac

SEQ ID NO: 1377351 - RNA, 24 nt, Human
caugccuguaaaccuagcacuuug

SEQ ID NO: 1377352 - RNA, 20 nt, Human
ccaaagugcugggauuacag

SEQ ID NO: 1377353 - RNA, 21 nt, Human
ccaaagugcugggauuacagg

SEQ ID NO: 1377354 - RNA, 21 nt, Human
ccaaagugcugggauuacagg

SEQ ID NO: 1377355 - RNA, 24 nt, Human
ccaaagugcugggauuacaggugu

SEQ ID NO: 1377356 - RNA, 24 nt, Human
ccaaguaucuggaguuacaggcau

SEQ ID NO: 1377357 - RNA, 19 nt, Human
ccacccaacuugguguccc

SEQ ID NO: 1377358 - RNA, 20 nt, Human
ccacggcacuccagccuggg

SEQ ID NO: 1377359 - RNA, 24 nt, Human
ccacggcacuccagccugggggac

SEQ ID NO: 1377360 - RNA, 22 nt, Human
ccaggcgcggccccagcccacg

SEQ ID NO: 1377361 - RNA, 22 nt, Human
ccauaccacaacuauucuccua

SEQ ID NO: 1377362 - RNA, 19 nt, Human
cccagcccacgucugaggc

SEQ ID NO: 1377363 - RNA, 20 nt, Human
cccaggcuggagugcaaugg

SEQ ID NO: 1377364 - RNA, 21 nt, Human
cccgggagguggagguugcag

SEQ ID NO: 1377365 - RNA, 22 nt, Human
ccucaggugacccacccaacuu

SEQ ID NO: 1377366 - RNA, 20 nt, Human
ccugaccucaggugacccac

SEQ ID NO: 1377367 - RNA, 24 nt, Human
ccugaccucaggugacccacccaa

SEQ ID NO: 1377368 - RNA, 21 nt, Human
ccugcaaucccagcuacucgg

SEQ ID NO: 1377369 - RNA, 22 nt, Human
ccugcaaucccagcuacucggg

SEQ ID NO: 1377370 - RNA, 22 nt, Human
ccugcagcggucggccaggagc

SEQ ID NO: 1377371 - RNA, 23 nt, Human
ccuggccaauauggugaaacccc

SEQ ID NO: 1377372 - RNA, 24 nt, Human
ccuggccaauauggugaaacccca

SEQ ID NO: 1377373 - RNA, 23 nt, Human
cgccacggcacuccagccugggg

SEQ ID NO: 1377374 - RNA, 24 nt, Human
cggaucacuugaggucaggaguuu

SEQ ID NO: 1377375 - RNA, 27 nt, Human
cggaucacuugaggucaggaguuugag

SEQ ID NO: 1377376 - RNA, 29 nt, Human
cgggagguggagguugcagugacaacggu

SEQ ID NO: 1377377 - RNA, 24 nt, Human
cgggagguggagguugcagugagc

SEQ ID NO: 1377378 - RNA, 26 nt, Human
cuaauuuuguauuuuuuuaguagaga

SEQ ID NO: 1377379 - RNA, 24 nt, Human
cucaugccuguaaaccuagcacuu

SEQ ID NO: 1377380 - RNA, 23 nt, Human
cucucuuguugcccaggcuggag

SEQ ID NO: 1377381 - RNA, 24 nt, Human
cucucuuguugcccaggcuggagu

SEQ ID NO: 1377382 - RNA, 18 nt, Human
cucuuguugcccaggcug

SEQ ID NO: 1377383 - RNA, 21 nt, Human
cucuuguugcccaggcuggag

SEQ ID NO: 1377384 - RNA, 19 nt, Human
cugcagauaaacacagaag

SEQ ID NO: 1377385 - RNA, 19 nt, Human
cuucacguaguaccagaac

SEQ ID NO: 1377386 - RNA, 24 nt, Human
cuucucucuuguugcccaggcugg

SEQ ID NO: 1377387 - RNA, 22 nt, Human
gaaaacggugaacuuaaccccc

SEQ ID NO: 1377388 - RNA, 18 nt, Human
gaccucaggugacccacc

SEQ ID NO: 1377389 - RNA, 24 nt, Human
gagaagggguuucaccauauuggu

SEQ ID NO: 1377390 - RNA, 23 nt, Human
gagaaucgcuugaacccgggagg

SEQ ID NO: 1377391 - RNA, 23 nt, Human
gagaucacgccacggcacuccag

SEQ ID NO: 1377392 - RNA, 22 nt, Human
gagguugcagugagcugagauc

SEQ ID NO: 1377393 - RNA, 24 nt, Human
gaucacuugaggucaggaguuuga

SEQ ID NO: 1377394 - RNA, 19 nt, Human
gaugcaaggaaaauccaga

SEQ ID NO: 1377395 - RNA, 18 nt, Human
gauuacaggugugagcca

SEQ ID NO: 1377396 - RNA, 22 nt, Human
gauuacaggugugagccacugc

SEQ ID NO: 1377397 - RNA, 22 nt, Human
gauuacaggugugagccacugc

SEQ ID NO: 1377398 - RNA, 20 nt, Human
gcaccaccaugccuggcuaa

SEQ ID NO: 1377399 - RNA, 24 nt, Human
gccaauauggugaaaccccaucuc

SEQ ID NO: 1377400 - RNA, 23 nt, Human
gcgcagccaggcgcggccccagc

SEQ ID NO: 1377401 - RNA, 21 nt, Human
gcggaucacuugaggucagga

SEQ ID NO: 1377402 - RNA, 23 nt, Human
gcuggucucaaacuccugaccuc

SEQ ID NO: 1377403 - RNA, 18 nt, Human
ggagguugcagugagcug

SEQ ID NO: 1377404 - RNA, 22 nt, Human
ggagguugcagugagcugagau

SEQ ID NO: 1377405 - RNA, 23 nt, Human
ggagguugcagugagcugagauc

SEQ ID NO: 1377406 - RNA, 24 nt, Human
ggagguugcagugagcugagauca

SEQ ID NO: 1377407 - RNA, 22 nt, Human
ggaucacuugaggucaggaguu

SEQ ID NO: 1377408 - RNA, 22 nt, Human
ggaucacuugaggucaggaguu

SEQ ID NO: 1377409 - RNA, 18 nt, Human
ggcucaugccuguaaacc

SEQ ID NO: 1377410 - RNA, 19 nt, Human
ggcugggcuugguggcuca

SEQ ID NO: 1377411 - RNA, 23 nt, Human
ggcugggcuugguggcucaugcc

SEQ ID NO: 1377412 - RNA, 24 nt, Human
ggcuggucucaaacuccugaccuc

SEQ ID NO: 1377413 - RNA, 20 nt, Human
ggcuugguggcucaugccug

SEQ ID NO: 1377414 - RNA, 24 nt, Human
gggcuugguggcucaugccuguaa

SEQ ID NO: 1377415 - RNA, 24 nt, Human
ggggaggcugggcuugguggcuca

SEQ ID NO: 1377416 - RNA, 18 nt, Human
gggguuucaccauauugg

SEQ ID NO: 1377417 - RNA, 22 nt, Human
gggguuucaccauauuggucag

SEQ ID NO: 1377418 - RNA, 23 nt, Human
gggguuucaccauauuggucagg

SEQ ID NO: 1377419 - RNA, 22 nt, Human
ggguuucaccauauuggucagg

SEQ ID NO: 1377420 - RNA, 19 nt, Human
ggucaggaguuugagacca

SEQ ID NO: 1377421 - RNA, 21 nt, Human
ggugcaguggauauuacagcu

SEQ ID NO: 1377422 - RNA, 19 nt, Human
gguggagguugcagugagc

SEQ ID NO: 1377423 - RNA, 24 nt, Human
gguggcucaugccuguaaaccuag

SEQ ID NO: 1377424 - RNA, 18 nt, Human
gucaucuuggcucugccu

SEQ ID NO: 1377425 - RNA, 20 nt, Human
gugcuaguggcaagucagau

SEQ ID NO: 1377426 - RNA, 23 nt, Human
gugcuuguugaggaccuccuuca

SEQ ID NO: 1377427 - RNA, 20 nt, Human
guggagguugcagugagcug

SEQ ID NO: 1377428 - RNA, 19 nt, Human
guugcagugagcugagauc

SEQ ID NO: 1377429 - RNA, 21 nt, Human
uaaaagcacaaggggaggcug

SEQ ID NO: 1377430 - RNA, 25 nt, Human
uaaaccuagcacuuugggaggccaa

SEQ ID NO: 1377431 - RNA, 25 nt, Human
uaacacuccuuccaaauaacacucc

SEQ ID NO: 1377432 - RNA, 24 nt, Human
uaauuuuguauuuuuuuaguagag

SEQ ID NO: 1377433 - RNA, 22 nt, Human
uacaggcaugcaccaccaugcc

SEQ ID NO: 1377434 - RNA, 22 nt, Human
uacaggugugagccacugcgcc

SEQ ID NO: 1377435 - RNA, 23 nt, Human
uacaggugugagccacugcgccu

SEQ ID NO: 1377436 - RNA, 20 nt, Human
uaccacaacuauucuccuag

SEQ ID NO: 1377437 - RNA, 19 nt, Human
uaccauagaaagagaaaac

SEQ ID NO: 1377438 - RNA, 18 nt, Human
uagaaagagaaaacggug

SEQ ID NO: 1377439 - RNA, 25 nt, Human
uagcacuuugggaggccaaggcagg

SEQ ID NO: 1377440 - RNA, 23 nt, Human
uaguagagaagggguuucaccau

SEQ ID NO: 1377441 - RNA, 24 nt, Human
uaguagagaagggguuucaccaua

SEQ ID NO: 1377442 - RNA, 19 nt, Human
uauaaaacuugcagaccua

SEQ ID NO: 1377443 - RNA, 24 nt, Human
uauaaagcaagaauuucaaggcac

SEQ ID NO: 1377444 - RNA, 22 nt, Human
ucaacaccugaagaaugaauga

SEQ ID NO: 1377445 - RNA, 23 nt, Human
ucacgccacggcacuccagccug

SEQ ID NO: 1377446 - RNA, 19 nt, Human
ucacuugaggucaggaguu

SEQ ID NO: 1377447 - RNA, 24 nt, Human
uccaaauaacacuccuaaaucaac

SEQ ID NO: 1377448 - RNA, 23 nt, Human
uccacuguuaaggcagcaggugc

SEQ ID NO: 1377449 - RNA, 21 nt, Human
uccagaguaaaaauaaaaaac

SEQ ID NO: 1377450 - RNA, 23 nt, Human
ucccaaagugcugggauuacagg

SEQ ID NO: 1377451 - RNA, 21 nt, Human
ucccauauucaagcgauucuc

SEQ ID NO: 1377452 - RNA, 24 nt, Human
ucccauauucaagcgauucuccug

SEQ ID NO: 1377453 - RNA, 24 nt, Human
ucgcuugaacccgggagguggagg

SEQ ID NO: 1377454 - RNA, 24 nt, Human
ucgggaggcugaggcaggagaauc

SEQ ID NO: 1377455 - RNA, 18 nt, Human
ucguccugagcuuccugu

SEQ ID NO: 1377456 - RNA, 21 nt, Human
ucucuacuaaaaauacaaaaa

SEQ ID NO: 1377457 - RNA, 22 nt, Human
ucucucuuguugcccaggcugg

SEQ ID NO: 1377458 - RNA, 23 nt, Human
ucucucuuguugcccaggcugga

SEQ ID NO: 1377459 - RNA, 22 nt, Human
ucuuguugcccaggcuggagug

SEQ ID NO: 1377460 - RNA, 19 nt, Human
ugaaaccccaucucuacua

SEQ ID NO: 1377461 - RNA, 22 nt, Human
ugaaaugaaaauuacagaugua

SEQ ID NO: 1377462 - RNA, 23 nt, Human
ugagaccagccuggccaauaugg

SEQ ID NO: 1377463 - RNA, 24 nt, Human
ugagaccagccuggccaauauggu

SEQ ID NO: 1377464 - RNA, 22 nt, Human
ugagcugagaucacgccacggc

SEQ ID NO: 1377465 - RNA, 20 nt, Human
ugaggcaggagaaucgcuug

SEQ ID NO: 1377466 - RNA, 24 nt, Human
ugaggcaggagaaucgcuugaacc

SEQ ID NO: 1377467 - RNA, 25 nt, Human
ugaggcaggagaaucgcuugaaccc

SEQ ID NO: 1377468 - RNA, 18 nt, Human
ugaggucaggaguuugag

SEQ ID NO: 1377469 - RNA, 18 nt, Human
ugcaaggaaaauccagag

SEQ ID NO: 1377470 - RNA, 18 nt, Human
ugcccaggcuggagugca

SEQ ID NO: 1377471 - RNA, 21 nt, Human
ugcccaggcuggagugcaaug

SEQ ID NO: 1377472 - RNA, 24 nt, Human
ugcccaggcuggagugcaauggug

SEQ ID NO: 1377473 - RNA, 23 nt, Human
ugcccucaaauguacucucuucc

SEQ ID NO: 1377474 - RNA, 24 nt, Human
ugccucagcaucccaaguaucugg

SEQ ID NO: 1377475 - RNA, 23 nt, Human
ugccugcaaucccagcuacucgg

SEQ ID NO: 1377476 - RNA, 24 nt, Human
ugccugcaaucccagcuacucggg

SEQ ID NO: 1377477 - RNA, 24 nt, Human
ugcugggauuacaggugugagcca

SEQ ID NO: 1377478 - RNA, 20 nt, Human
uggagugcaauggugucauc

SEQ ID NO: 1377479 - RNA, 23 nt, Human
uggagugcaauggugucaucuug

SEQ ID NO: 1377480 - RNA, 24 nt, Human
uggagugcaauggugucaucuugg

SEQ ID NO: 1377481 - RNA, 24 nt, Human
uggaguuacaggcaugcaccacca

SEQ ID NO: 1377482 - RNA, 24 nt, Human
uggccaauauggugaaaccccauc

SEQ ID NO: 1377483 - RNA, 19 nt, Human
uggcucaugccuguaaacc

SEQ ID NO: 1377484 - RNA, 24 nt, Human
uggcucaugccuguaaaccuagca

SEQ ID NO: 1377485 - RNA, 24 nt, Human
ugggaggccaaggcaggcggauca

SEQ ID NO: 1377486 - RNA, 18 nt, Human
ugggauuacaggugugag

SEQ ID NO: 1377487 - RNA, 19 nt, Human
ugggauuacaggugugagc

SEQ ID NO: 1377488 - RNA, 21 nt, Human
ugggauuacaggugugagcca

SEQ ID NO: 1377489 - RNA, 22 nt, Human
ugggauuacaggugugagccac

SEQ ID NO: 1377490 - RNA, 22 nt, Human
ugggauuacaggugugagccac

SEQ ID NO: 1377491 - RNA, 24 nt, Human
ugggauuacaggugugagccacug

SEQ ID NO: 1377492 - RNA, 24 nt, Human
uggucaggcuggucucaaacuccu

SEQ ID NO: 1377493 - RNA, 22 nt, Human
ugguggcucaugccuguaaacc

SEQ ID NO: 1377494 - RNA, 22 nt, Human
uguugaggaccuccuucacgua

SEQ ID NO: 1377495 - RNA, 20 nt, Human
uguugcccaggcuggagugc

SEQ ID NO: 1377496 - RNA, 22 nt, Human
uguugcccaggcuggagugcaa

SEQ ID NO: 1377497 - RNA, 24 nt, Human
uuagcuggguguggugucaggugc

SEQ ID NO: 1377498 - RNA, 18 nt, Human
uuaguagagaagggguuu

SEQ ID NO: 1377499 - RNA, 22 nt, Human
uuaguagagaagggguuucacc

SEQ ID NO: 1377500 - RNA, 24 nt, Human
uuaguagagaagggguuucaccau

SEQ ID NO: 1377501 - RNA, 21 nt, Human
uucaagcgauucuccugccuc

SEQ ID NO: 1377502 - RNA, 23 nt, Human
uucaagcgauucuccugccucag

SEQ ID NO: 1377503 - RNA, 24 nt, Human
uucaagcgauucuccugccucagc

SEQ ID NO: 1377504 - RNA, 24 nt, Human
uucucucuuguugcccaggcugga

SEQ ID NO: 1377505 - RNA, 24 nt, Human
uugaacccgggagguggagguugc

SEQ ID NO: 1377506 - RNA, 18 nt, Human
uugcagugagcugagauc

SEQ ID NO: 1377507 - RNA, 20 nt, Human
uugcagugagcugagaucac

SEQ ID NO: 1377508 - RNA, 21 nt, Human
uugcagugagcugagaucacg

SEQ ID NO: 1377509 - RNA, 27 nt, Human
uugcccaggcuggagugcaaugguguc

SEQ ID NO: 1377510 - RNA, 24 nt, Human
uuucaccauauuggucaggcuggu

SEQ ID NO: 1377511 - RNA, 22 nt, Human
uuuuguauuuuuuuaguagaga

SEQ ID NO: 1377512 - RNA, 24 nt, Human
uuuuuaguagagaagggguuucac

SEQ ID NO: 1377513 - RNA, 25 nt, Human
uuuuuuuaguagagaagggguuuca

SEQ ID NO: 1377514 - RNA, 23 nt, Human
aaacugccgggaaaauauaacaa

SEQ ID NO: 1377515 - RNA, 24 nt, Human
aaaggcuuuaccauggccuacagg

SEQ ID NO: 1377516 - RNA, 23 nt, Human
aaaguccuauaccuucucuccuc

SEQ ID NO: 1377517 - RNA, 19 nt, Human
aacagagacaacuuucgga

SEQ ID NO: 1377518 - RNA, 19 nt, Human
aagugcugggauuacaggc

SEQ ID NO: 1377519 - RNA, 19 nt, Human
aagugcugggauuacaggc

SEQ ID NO: 1377520 - RNA, 23 nt, Human
aagugcugggauuacaggcguga

SEQ ID NO: 1377521 - RNA, 26 nt, Human
aagugcugggauuacaggcgugagcc

SEQ ID NO: 1377522 - RNA, 24 nt, Human
aaucaccagaagaguagaaaaagg

SEQ ID NO: 1377523 - RNA, 24 nt, Human
aauuuuuguauuuuaguagagacg

SEQ ID NO: 1377524 - RNA, 19 nt, Human
acaggcaccugccaccacg

SEQ ID NO: 1377525 - RNA, 18 nt, Human
acgagguuucaccauguu

SEQ ID NO: 1377526 - RNA, 20 nt, Human
acgagguuucaccauguugg

SEQ ID NO: 1377527 - RNA, 24 nt, Human
acgagguuucaccauguuggccag

SEQ ID NO: 1377528 - RNA, 21 nt, Human
acucacucugucacccaagcu

SEQ ID NO: 1377529 - RNA, 24 nt, Human
acucacucugucacccaagcugga

SEQ ID NO: 1377530 - RNA, 24 nt, Human
acucccuuggccucccgaagugcu

SEQ ID NO: 1377531 - RNA, 18 nt, Human
acucugucacccaagcug

SEQ ID NO: 1377532 - RNA, 30 nt, Human
acucugucacccaagcuggagagcaauggg

SEQ ID NO: 1377533 - RNA, 18 nt, Human
agcacagaacagagacaa

SEQ ID NO: 1377534 - RNA, 23 nt, Human
agccagaguaaccccauaaaaau

SEQ ID NO: 1377535 - RNA, 23 nt, Human
aggugauccacucccuuggccuc

SEQ ID NO: 1377536 - RNA, 24 nt, Human
aguagccacccccauccccaaguc

SEQ ID NO: 1377537 - RNA, 21 nt, Human
aguagcugggauuacaggcac

SEQ ID NO: 1377538 - RNA, 23 nt, Human
aguagcugggauuacaggcaccu

SEQ ID NO: 1377539 - RNA, 18 nt, Human
agugcugggauuacaggc

SEQ ID NO: 1377540 - RNA, 19 nt, Human
augccacacuacuccucag

SEQ ID NO: 1377541 - RNA, 24 nt, Human
auuuuaguagagacgagguuucac

SEQ ID NO: 1377542 - RNA, 20 nt, Human
caaccuccaccucccagguu

SEQ ID NO: 1377543 - RNA, 23 nt, Human
caaccuccaccucccagguucaa

SEQ ID NO: 1377544 - RNA, 22 nt, Human
caagcaauucuccugucucagc

SEQ ID NO: 1377545 - RNA, 22 nt, Human
cacaagucaaauagcacagaac

SEQ ID NO: 1377546 - RNA, 24 nt, Human
cacaagucaaauagcacagaacag

SEQ ID NO: 1377547 - RNA, 21 nt, Human
cacagagaugucaccuuaaac

SEQ ID NO: 1377548 - RNA, 21 nt, Human
caccacaaccuccaccuccca

SEQ ID NO: 1377549 - RNA, 21 nt, Human
caccacaaccuccaccuccca

SEQ ID NO: 1377550 - RNA, 24 nt, Human
caccacgcccggcuaauuuuugua

SEQ ID NO: 1377551 - RNA, 18 nt, Human
caccauguuggccaggcu

SEQ ID NO: 1377552 - RNA, 24 nt, Human
caccauguuggccaggcuugucuc

SEQ ID NO: 1377553 - RNA, 22 nt, Human
cacccaagcuggagagcaaugg

SEQ ID NO: 1377554 - RNA, 18 nt, Human
cacccccauccccaaguc

SEQ ID NO: 1377555 - RNA, 19 nt, Human
cacccccauccccaaguca

SEQ ID NO: 1377556 - RNA, 20 nt, Human
cacccccauccccaagucaa

SEQ ID NO: 1377557 - RNA, 24 nt, Human
cacuagcccauucuacaucugcac

SEQ ID NO: 1377558 - RNA, 23 nt, Human
cacucugucacccaagcuggaga

SEQ ID NO: 1377559 - RNA, 25 nt, Human
cacucugucacccaagcuggagagc

SEQ ID NO: 1377560 - RNA, 20 nt, Human
cagccuccugaguagcuggg

SEQ ID NO: 1377561 - RNA, 21 nt, Human
caggcaccugccaccacgccc

SEQ ID NO: 1377562 - RNA, 18 nt, Human
cauucuacaucugcacaa

SEQ ID NO: 1377563 - RNA, 24 nt, Human
ccacaaccuccaccucccagguuc

SEQ ID NO: 1377564 - RNA, 20 nt, Human
ccaccacgcccggcuaauuu

SEQ ID NO: 1377565 - RNA, 19 nt, Human
ccaccaugcccagccaaca

SEQ ID NO: 1377566 - RNA, 27 nt, Human
ccaccucccagguucaagcaauucuuu

SEQ ID NO: 1377567 - RNA, 19 nt, Human
ccagaagaguagaaaaagg

SEQ ID NO: 1377568 - RNA, 18 nt, Human
cccacucuuucucuucac

SEQ ID NO: 1377569 - RNA, 23 nt, Human
cccacuguggacauggugggggc

SEQ ID NO: 1377570 - RNA, 23 nt, Human
cccagguucaagcaauucuccug

SEQ ID NO: 1377571 - RNA, 24 nt, Human
cccgaagugcugggauuacaggcg

SEQ ID NO: 1377572 - RNA, 24 nt, Human
ccgaagugcugggauuacaggcgu

SEQ ID NO: 1377573 - RNA, 24 nt, Human
ccucccagguucaagcaauucucc

SEQ ID NO: 1377574 - RNA, 20 nt, Human
ccugaccucaggugauccac

SEQ ID NO: 1377575 - RNA, 20 nt, Human
ccugaccucaggugauccac

SEQ ID NO: 1377576 - RNA, 24 nt, Human
ccugaccucaggugauccacuccc

SEQ ID NO: 1377577 - RNA, 23 nt, Human
ccugaguagcugggauuacaggc

SEQ ID NO: 1377578 - RNA, 24 nt, Human
ccugaguagcugggauuacaggca

SEQ ID NO: 1377579 - RNA, 24 nt, Human
ccugucucagccuccugaguagcu

SEQ ID NO: 1377580 - RNA, 24 nt, Human
cgaagugcugggauuacaggcgug

SEQ ID NO: 1377581 - RNA, 24 nt, Human
cgagguuucaccauguuggccagg

SEQ ID NO: 1377582 - RNA, 22 nt, Human
cuaaugccacacuacuccucag

SEQ ID NO: 1377583 - RNA, 24 nt, Human
cucaccacaaccuccaccucccag

SEQ ID NO: 1377584 - RNA, 23 nt, Human
cucacucugucacccaagcugga

SEQ ID NO: 1377585 - RNA, 24 nt, Human
cucacucugucacccaagcuggag

SEQ ID NO: 1377586 - RNA, 23 nt, Human
cucagccuccugaguagcuggga

SEQ ID NO: 1377587 - RNA, 21 nt, Human
cucucagaccccaucuaaugc

SEQ ID NO: 1377588 - RNA, 23 nt, Human
cugaguagcugggauuacaggca

SEQ ID NO: 1377589 - RNA, 19 nt, Human
cuuuauuugaagauguugg

SEQ ID NO: 1377590 - RNA, 18 nt, Human
gaagaguagaaaaaggcu

SEQ ID NO: 1377591 - RNA, 24 nt, Human
gaagugcugggauuacaggcguga

SEQ ID NO: 1377592 - RNA, 23 nt, Human
gaccucaggugauccacucccuu

SEQ ID NO: 1377593 - RNA, 23 nt, Human
gagguuucaccauguuggccagg

SEQ ID NO: 1377594 - RNA, 18 nt, Human
gauuacaggcgugagcca

SEQ ID NO: 1377595 - RNA, 21 nt, Human
gauuacaggcgugagccacca

SEQ ID NO: 1377596 - RNA, 24 nt, Human
gauuacaggcgugagccaccaugc

SEQ ID NO: 1377597 - RNA, 22 nt, Human
gcccggcuaauuuuuguauuuu

SEQ ID NO: 1377598 - RNA, 24 nt, Human
ggauuacaggcgugagccaccaug

SEQ ID NO: 1377599 - RNA, 20 nt, Human
ggcaaauauaugguccaagg

SEQ ID NO: 1377600 - RNA, 23 nt, Human
ggugauccacucccuuggccucc

SEQ ID NO: 1377601 - RNA, 18 nt, Human
guagcugggauuacaggc

SEQ ID NO: 1377602 - RNA, 23 nt, Human
gugauccacucccuuggccuccc

SEQ ID NO: 1377603 - RNA, 19 nt, Human
uaaaugcccuucuuugcuc

SEQ ID NO: 1377604 - RNA, 22 nt, Human
uaacugggccaugauggcugaa

SEQ ID NO: 1377605 - RNA, 20 nt, Human
uaacuucugacuuguuccuu

SEQ ID NO: 1377606 - RNA, 24 nt, Human
uaaucaagccauuuggugaaaauc

SEQ ID NO: 1377607 - RNA, 23 nt, Human
uaauuuuuguauuuuaguagaga

SEQ ID NO: 1377608 - RNA, 23 nt, Human
uacaggcaccugccaccacgccc

SEQ ID NO: 1377609 - RNA, 24 nt, Human
uacaggcgugagccaccaugccca

SEQ ID NO: 1377610 - RNA, 20 nt, Human
uaccuacucccaagcucaaa

SEQ ID NO: 1377611 - RNA, 19 nt, Human
uagaaaaaggcuuuaccau

SEQ ID NO: 1377612 - RNA, 22 nt, Human
uagagacgagguuucaccaugu

SEQ ID NO: 1377613 - RNA, 23 nt, Human
uagcaaaaagguucagaagaaaa

SEQ ID NO: 1377614 - RNA, 24 nt, Human
uaguagagacgagguuucaccaug

SEQ ID NO: 1377615 - RNA, 26 nt, Human
uaguagagacgagguuucaccauguu

SEQ ID NO: 1377616 - RNA, 20 nt, Human
uaugcuccccuucuucacug

SEQ ID NO: 1377617 - RNA, 19 nt, Human
uauuuugcuaccuacuccc

SEQ ID NO: 1377618 - RNA, 24 nt, Human
ucaccacaaccuccaccucccagg

SEQ ID NO: 1377619 - RNA, 27 nt, Human
ucaccacaaccuccaccucccagguuc

SEQ ID NO: 1377620 - RNA, 20 nt, Human
ucagccuccugaguagcugg

SEQ ID NO: 1377621 - RNA, 26 nt, Human
ucagcucaccacaaccuccaccuccc

SEQ ID NO: 1377622 - RNA, 18 nt, Human
ucaggguccuauacaaag

SEQ ID NO: 1377623 - RNA, 18 nt, Human
uccaacuccugaccucag

SEQ ID NO: 1377624 - RNA, 21 nt, Human
uccacaguuaccuucugacca

SEQ ID NO: 1377625 - RNA, 21 nt, Human
ucccagguucaagcaauucuc

SEQ ID NO: 1377626 - RNA, 24 nt, Human
ucccagguucaagcaauucuccug

SEQ ID NO: 1377627 - RNA, 19 nt, Human
ucccgaagugcugggauua

SEQ ID NO: 1377628 - RNA, 24 nt, Human
ucccgaagugcugggauuacaggc

SEQ ID NO: 1377629 - RNA, 23 nt, Human
ucccuuggccucccgaagugcug

SEQ ID NO: 1377630 - RNA, 24 nt, Human
uccugaguagcugggauuacaggc

SEQ ID NO: 1377631 - RNA, 24 nt, Human
uccuggcaaauauaugguccaagg

SEQ ID NO: 1377632 - RNA, 24 nt, Human
uccuguguaacucucagaccccau

SEQ ID NO: 1377633 - RNA, 22 nt, Human
ucuaaugccacacuacuccuca

SEQ ID NO: 1377634 - RNA, 28 nt, Human
ucucacucacucugucacccaagcugga

SEQ ID NO: 1377635 - RNA, 22 nt, Human
ucuccucaaaccuuuuucuccc

SEQ ID NO: 1377636 - RNA, 24 nt, Human
ucuccugucucagccuccugagua

SEQ ID NO: 1377637 - RNA, 19 nt, Human
ugaccucaggugauccacu

SEQ ID NO: 1377638 - RNA, 20 nt, Human
ugaccucaggugauccacuc

SEQ ID NO: 1377639 - RNA, 22 nt, Human
ugaccucaggugauccacuccc

SEQ ID NO: 1377640 - RNA, 26 nt, Human
ugagauggagucucacucacucuguc

SEQ ID NO: 1377641 - RNA, 18 nt, Human
ugcaaggaauuccauuga

SEQ ID NO: 1377642 - RNA, 20 nt, Human
ugcacagagaugucaccuua

SEQ ID NO: 1377643 - RNA, 24 nt, Human
ugcugggauuacaggcgugagcca

SEQ ID NO: 1377644 - RNA, 24 nt, Human
uggccaggcuugucuccaacuccu

SEQ ID NO: 1377645 - RNA, 20 nt, Human
uggcccagaagagaaugcaa

SEQ ID NO: 1377646 - RNA, 25 nt, Human
uggccuacaggcuccacauguuccu

SEQ ID NO: 1377647 - RNA, 24 nt, Human
uggcgcgaucucagcucaccacaa

SEQ ID NO: 1377648 - RNA, 21 nt, Human
ugggauuacaggcaccugcca

SEQ ID NO: 1377649 - RNA, 22 nt, Human
ugggauuacaggcaccugccac

SEQ ID NO: 1377650 - RNA, 24 nt, Human
ugggauuacaggcaccugccacca

SEQ ID NO: 1377651 - RNA, 18 nt, Human
ugggauuacaggcgugag

SEQ ID NO: 1377652 - RNA, 22 nt, Human
ugggauuacaggcgugagccac

SEQ ID NO: 1377653 - RNA, 23 nt, Human
ugggauuacaggcgugagccacc

SEQ ID NO: 1377654 - RNA, 24 nt, Human
ugggauuacaggcgugagccacca

SEQ ID NO: 1377655 - RNA, 25 nt, Human
ugggauuacaggcgugagccaccau

SEQ ID NO: 1377656 - RNA, 24 nt, Human
ugucucagccuccugaguagcugg

SEQ ID NO: 1377657 - RNA, 24 nt, Human
uuaguagagacgagguuucaccau

SEQ ID NO: 1377658 - RNA, 24 nt, Human
uucagaagaaaacugccgggaaaa

SEQ ID NO: 1377659 - RNA, 23 nt, Human
uucaugucuuuuucuccucucaa

SEQ ID NO: 1377660 - RNA, 20 nt, Human
uucccaaguggccucccaga

SEQ ID NO: 1377661 - RNA, 22 nt, Human
uuccucaaagaugugugucagg

SEQ ID NO: 1377662 - RNA, 24 nt, Human
uuccucauaaccacuucuuuauuu

SEQ ID NO: 1377663 - RNA, 24 nt, Human
uucugaucauuccucauaaccacu

SEQ ID NO: 1377664 - RNA, 22 nt, Human
uugaagauguuggagaacuuac

SEQ ID NO: 1377665 - RNA, 21 nt, Human
uuguaguugagagccugugug

SEQ ID NO: 1377666 - RNA, 24 nt, Human
uuucaccauguuggccaggcuugu

SEQ ID NO: 1377667 - RNA, 18 nt, Human
uuucggagcccacugugg

SEQ ID NO: 1377668 - RNA, 19 nt, Human
uuuuuguauuuuaguagag

SEQ ID NO: 1377669 - RNA, 26 nt, Human
uuuuuuuuuuuugagauggagucuca

SEQ ID NO: 1377670 - RNA, 18 nt, Human
aaaaaaaaaaaaaaugaa

SEQ ID NO: 1377671 - RNA, 22 nt, Human
aaaaaaaaaaaaaaugaaguag

SEQ ID NO: 1377672 - RNA, 22 nt, Human
aaaaggacaagacgcugucaaa

SEQ ID NO: 1377673 - RNA, 20 nt, Human
aaacaaaaaauuuagaagau

SEQ ID NO: 1377674 - RNA, 22 nt, Human
aaacaaaagaagguaaaauuag

SEQ ID NO: 1377675 - RNA, 19 nt, Human
aaagcuccuccaaacacau

SEQ ID NO: 1377676 - RNA, 24 nt, Human
aaagugcugggauuacaggcauga

SEQ ID NO: 1377677 - RNA, 24 nt, Human
aacaaaaaauuuagaagauuuuaa

SEQ ID NO: 1377678 - RNA, 23 nt, Human
aacaaauuucaugaugcuagacu

SEQ ID NO: 1377679 - RNA, 19 nt, Human
aagugcugggauuacaggc

SEQ ID NO: 1377680 - RNA, 21 nt, Human
aagugcugggauuacaggcau

SEQ ID NO: 1377681 - RNA, 26 nt, Human
aagugcugggauuacaggcaugagcc

SEQ ID NO: 1377682 - RNA, 18 nt, Human
acgggguuucaccauguu

SEQ ID NO: 1377683 - RNA, 19 nt, Human
acgggguuucaccauguua

SEQ ID NO: 1377684 - RNA, 20 nt, Human
acgggguuucaccauguuag

SEQ ID NO: 1377685 - RNA, 24 nt, Human
acgggguuucaccauguuagccag

SEQ ID NO: 1377686 - RNA, 18 nt, Human
acuggacuccagccuggg

SEQ ID NO: 1377687 - RNA, 18 nt, Human
aggauggggagggaggag

SEQ ID NO: 1377688 - RNA, 20 nt, Human
aggcaggagaauuuuuaacc

SEQ ID NO: 1377689 - RNA, 21 nt, Human
aggcaggagaauuuuuaaccu

SEQ ID NO: 1377690 - RNA, 22 nt, Human
aggcaggagaauuuuuaaccug

SEQ ID NO: 1377691 - RNA, 23 nt, Human
aggcaggagaauuuuuaaccugg

SEQ ID NO: 1377692 - RNA, 18 nt, Human
aggcaugagccaccaagc

SEQ ID NO: 1377693 - RNA, 21 nt, Human
aggcaugagccaccaagccug

SEQ ID NO: 1377694 - RNA, 19 nt, Human
aggcugaggcaggagaauu

SEQ ID NO: 1377695 - RNA, 21 nt, Human
aggugaacauuagaaacaacu

SEQ ID NO: 1377696 - RNA, 18 nt, Human
agugcugggauuacaggc

SEQ ID NO: 1377697 - RNA, 18 nt, Human
aguggcugcgcaugccug

SEQ ID NO: 1377698 - RNA, 22 nt, Human
auaaaucacauauuaugaauaa

SEQ ID NO: 1377699 - RNA, 24 nt, Human
augaugcuagacuaggauggggag

SEQ ID NO: 1377700 - RNA, 19 nt, Human
auggggagggaggagagga

SEQ ID NO: 1377701 - RNA, 21 nt, Human
auggggguaaaagcuccucca

SEQ ID NO: 1377702 - RNA, 24 nt, Human
auugcaccacuggacuccagccug

SEQ ID NO: 1377703 - RNA, 20 nt, Human
caaaaaaaaaaaaaaugaag

SEQ ID NO: 1377704 - RNA, 24 nt, Human
caaagugcugggauuacaggcaug

SEQ ID NO: 1377705 - RNA, 18 nt, Human
caccauguuagccaggau

SEQ ID NO: 1377706 - RNA, 22 nt, Human
caccauguuagccaggaugguc

SEQ ID NO: 1377707 - RNA, 24 nt, Human
caccauguuagccaggauggucuc

SEQ ID NO: 1377708 - RNA, 19 nt, Human
cacuggacuccagccuggg

SEQ ID NO: 1377709 - RNA, 19 nt, Human
cacugucuaaaagucuucc

SEQ ID NO: 1377710 - RNA, 22 nt, Human
cagaaacagcauuaaaaugaga

SEQ ID NO: 1377711 - RNA, 21 nt, Human
cagcauuaaaaugagaccaaa

SEQ ID NO: 1377712 - RNA, 24 nt, Human
cagcuacucaggaggcugaggcag

SEQ ID NO: 1377713 - RNA, 19 nt, Human
caguaugaauucucugaug

SEQ ID NO: 1377714 - RNA, 20 nt, Human
caguaugaauucuuugaugu

SEQ ID NO: 1377715 - RNA, 22 nt, Human
cauuagaaacaacuucaauguc

SEQ ID NO: 1377716 - RNA, 23 nt, Human
ccaaagugcugggauuacaggca

SEQ ID NO: 1377717 - RNA, 24 nt, Human
ccaaagugcugggauuacaggcau

SEQ ID NO: 1377718 - RNA, 20 nt, Human
ccacuggacuccagccuggg

SEQ ID NO: 1377719 - RNA, 20 nt, Human
ccacuggacuccagccuggg

SEQ ID NO: 1377720 - RNA, 21 nt, Human
ccacuggacuccagccugggu

SEQ ID NO: 1377721 - RNA, 24 nt, Human
cccaaagugcugggauuacaggca

SEQ ID NO: 1377722 - RNA, 18 nt, Human
cccacuguugggaaucug

SEQ ID NO: 1377723 - RNA, 21 nt, Human
ccuguagucccagcuacucag

SEQ ID NO: 1377724 - RNA, 24 nt, Human
cgccucggccucccaaagugcugg

SEQ ID NO: 1377725 - RNA, 24 nt, Human
cgggguuucaccauguuagccagg

SEQ ID NO: 1377726 - RNA, 22 nt, Human
cuaaaggccuucccacauuccu

SEQ ID NO: 1377727 - RNA, 19 nt, Human
cuccuccaaacacaugcaa

SEQ ID NO: 1377728 - RNA, 24 nt, Human
cuccugaccucgugauccgcccgc

SEQ ID NO: 1377729 - RNA, 24 nt, Human
cugcacaauagaaacaaaagaagg

SEQ ID NO: 1377730 - RNA, 21 nt, Human
cuugaaugauagcuaaaggcc

SEQ ID NO: 1377731 - RNA, 20 nt, Human
cuuuccagaaugaauucucu

SEQ ID NO: 1377732 - RNA, 22 nt, Human
gaccucgugauccgcccgccuc

SEQ ID NO: 1377733 - RNA, 22 nt, Human
gaccucgugauccgcccgccuc

SEQ ID NO: 1377734 - RNA, 24 nt, Human
gaccucgugauccgcccgccucgg

SEQ ID NO: 1377735 - RNA, 24 nt, Human
gagacgggguuucaccauguuagc

SEQ ID NO: 1377736 - RNA, 18 nt, Human
gagggaggagaggaaacc

SEQ ID NO: 1377737 - RNA, 18 nt, Human
gagguugcagugagccaa

SEQ ID NO: 1377738 - RNA, 21 nt, Human
gagguugcagugagccaagau

SEQ ID NO: 1377739 - RNA, 23 nt, Human
gagguugcagugagccaagauug

SEQ ID NO: 1377740 - RNA, 18 nt, Human
gauagcuaaaggccuucc

SEQ ID NO: 1377741 - RNA, 18 nt, Human
gauuacaggcaugagcca

SEQ ID NO: 1377742 - RNA, 21 nt, Human
gauuacaggcaugagccacca

SEQ ID NO: 1377743 - RNA, 24 nt, Human
gauuacaggcaugagccaccaagc

SEQ ID NO: 1377744 - RNA, 20 nt, Human
gccagauacucuuuaauccc

SEQ ID NO: 1377745 - RNA, 22 nt, Human
ggagguugcagugagccaagau

SEQ ID NO: 1377746 - RNA, 24 nt, Human
ggagguugcagugagccaagauug

SEQ ID NO: 1377747 - RNA, 24 nt, Human
ggauggucucgaucuccugaccuc

SEQ ID NO: 1377748 - RNA, 19 nt, Human
ggauuacaggcaugagcca

SEQ ID NO: 1377749 - RNA, 19 nt, Human
ggcggagguugcagugagc

SEQ ID NO: 1377750 - RNA, 23 nt, Human
ggcggagguugcagugagccaag

SEQ ID NO: 1377751 - RNA, 23 nt, Human
gggguuucaccauguuagccagg

SEQ ID NO: 1377752 - RNA, 23 nt, Human
ggguggcggagguugcagugagc

SEQ ID NO: 1377753 - RNA, 24 nt, Human
gguuucaccauguuagccaggaug

SEQ ID NO: 1377754 - RNA, 25 nt, Human
guaaaagcuccuccaaacacaugca

SEQ ID NO: 1377755 - RNA, 26 nt, Human
guaaaagcuccuccaaacacaugcaa

SEQ ID NO: 1377756 - RNA, 24 nt, Human
guaauaaaucacauauuaugaaua

SEQ ID NO: 1377757 - RNA, 23 nt, Human
guagagacgggguuucaccaugu

SEQ ID NO: 1377758 - RNA, 24 nt, Human
gugauccgcccgccucggccuccc

SEQ ID NO: 1377759 - RNA, 19 nt, Human
uaaaacaaagacaauguau

SEQ ID NO: 1377760 - RNA, 18 nt, Human
uaaaaggaaacugauagc

SEQ ID NO: 1377761 - RNA, 23 nt, Human
uaaaaugagaccaaaauuuacac

SEQ ID NO: 1377762 - RNA, 24 nt, Human
uaaaaugagaccaaaauuuacacu

SEQ ID NO: 1377763 - RNA, 22 nt, Human
uaaauaaauacuaaugaaacug

SEQ ID NO: 1377764 - RNA, 22 nt, Human
uaacucagaaacagcauuaaaa

SEQ ID NO: 1377765 - RNA, 20 nt, Human
uacaggcaugagccaccaag

SEQ ID NO: 1377766 - RNA, 22 nt, Human
uacaggcaugagccaccaagcc

SEQ ID NO: 1377767 - RNA, 22 nt, Human
uagagacgggguuucaccaugu

SEQ ID NO: 1377768 - RNA, 23 nt, Human
uaguagagacgggguuucaccau

SEQ ID NO: 1377769 - RNA, 24 nt, Human
uaguagagacgggguuucaccaug

SEQ ID NO: 1377770 - RNA, 26 nt, Human
uaguagagacgggguuucaccauguu

SEQ ID NO: 1377771 - RNA, 27 nt, Human
uaguggcugcgcaugccuguaguccca

SEQ ID NO: 1377772 - RNA, 24 nt, Human
uauuucacugguuucagugaaaca

SEQ ID NO: 1377773 - RNA, 23 nt, Human
uauuucacuguuucagugaaaua

SEQ ID NO: 1377774 - RNA, 24 nt, Human
ucaccauguuagccaggauggucu

SEQ ID NO: 1377775 - RNA, 18 nt, Human
ucagaaacagcauuaaaa

SEQ ID NO: 1377776 - RNA, 21 nt, Human
uccaaacacaugcaaaaaaug

SEQ ID NO: 1377777 - RNA, 24 nt, Human
uccaucaacaaauuucaugaugcu

SEQ ID NO: 1377778 - RNA, 25 nt, Human
uccaucaacaaauuucaugaugcua

SEQ ID NO: 1377779 - RNA, 24 nt, Human
ucccaaagugcugggauuacaggc

SEQ ID NO: 1377780 - RNA, 19 nt, Human
ucccacuguugggaaucug

SEQ ID NO: 1377781 - RNA, 18 nt, Human
ucggccucccaaagugcu

SEQ ID NO: 1377782 - RNA, 22 nt, Human
ucuaaaagucuucccacauucc

SEQ ID NO: 1377783 - RNA, 18 nt, Human
ucucaaaaaaaaaaaaaa

SEQ ID NO: 1377784 - RNA, 23 nt, Human
ucuuuugaggugugaacacuguc

SEQ ID NO: 1377785 - RNA, 22 nt, Human
ugaggcaggagaauuuuuaacc

SEQ ID NO: 1377786 - RNA, 22 nt, Human
ugaggcaggagaauuuuuaacc

SEQ ID NO: 1377787 - RNA, 24 nt, Human
ugaggcaggagaauuuuuaaccug

SEQ ID NO: 1377788 - RNA, 25 nt, Human
ugaggcaggagaauuuuuaaccugg

SEQ ID NO: 1377789 - RNA, 22 nt, Human
ugcacaauagaaacaaaagaag

SEQ ID NO: 1377790 - RNA, 24 nt, Human
ugccuguagucccagcuacucagg

SEQ ID NO: 1377791 - RNA, 24 nt, Human
uggcggagguugcagugagccaag

SEQ ID NO: 1377792 - RNA, 21 nt, Human
uggcuacagaacuggauguua

SEQ ID NO: 1377793 - RNA, 24 nt, Human
uggcugcgcaugccuguaguccca

SEQ ID NO: 1377794 - RNA, 18 nt, Human
ugggauuacaggcaugag

SEQ ID NO: 1377795 - RNA, 19 nt, Human
ugggauuacaggcaugagc

SEQ ID NO: 1377796 - RNA, 22 nt, Human
ugggauuacaggcaugagccac

SEQ ID NO: 1377797 - RNA, 23 nt, Human
ugggauuacaggcaugagccacc

SEQ ID NO: 1377798 - RNA, 24 nt, Human
ugggauuacaggcaugagccacca

SEQ ID NO: 1377799 - RNA, 25 nt, Human
ugggugugucucaaaaaaaaaaaaa

SEQ ID NO: 1377800 - RNA, 26 nt, Human
ugggugugucucaaaaaaaaaaaaaa

SEQ ID NO: 1377801 - RNA, 20 nt, Human
ugucuaaaagucuucccaca

SEQ ID NO: 1377802 - RNA, 28 nt, Human
uucagugaaauauuucacugguuucagu

SEQ ID NO: 1377803 - RNA, 20 nt, Human
uucauuuuauuucacuguuu

SEQ ID NO: 1377804 - RNA, 23 nt, Human
uugcaccacuggacuccagccug

SEQ ID NO: 1377805 - RNA, 22 nt, Human
uugcagugagccaagauugcac

SEQ ID NO: 1377806 - RNA, 18 nt, Human
uuuaugaaauuuacauga

SEQ ID NO: 1377807 - RNA, 19 nt, Human
uuucaccauguuagccagg

SEQ ID NO: 1377808 - RNA, 20 nt, Human
uuucaccauguuagccagga

SEQ ID NO: 1377809 - RNA, 18 nt, Human
uuuccaucaacaaauuuc

SEQ ID NO: 1377810 - RNA, 18 nt, Human
auccacaguaaacaggau

SEQ ID NO: 1377811 - RNA, 23 nt, Human
cagacccaacccucagggggguu

SEQ ID NO: 1377812 - RNA, 23 nt, Human
caggauuaucauucccauaauau

SEQ ID NO: 1377813 - RNA, 21 nt, Human
cagugccuucucagaggcccc

SEQ ID NO: 1377814 - RNA, 19 nt, Human
cagugugaauucucugaug

SEQ ID NO: 1377815 - RNA, 24 nt, Human
ccaacccucagggggguuuucuca

SEQ ID NO: 1377816 - RNA, 19 nt, Human
ccagugugaauucucugau

SEQ ID NO: 1377817 - RNA, 22 nt, Human
cccacacucaguacauauggaa

SEQ ID NO: 1377818 - RNA, 18 nt, Human
gccaugugugacauucug

SEQ ID NO: 1377819 - RNA, 20 nt, Human
uaacaguauucuauuguagu

SEQ ID NO: 1377820 - RNA, 21 nt, Human
ucacugcauucauaagguuuc

SEQ ID NO: 1377821 - RNA, 25 nt, Human
ucagacccaacccucagggggguuu

SEQ ID NO: 1377822 - RNA, 22 nt, Human
ucagaggcccucuccagaacag

SEQ ID NO: 1377823 - RNA, 24 nt, Human
ucagugccuucucagaggcccucu

SEQ ID NO: 1377824 - RNA, 18 nt, Human
ucuacuuugaaucuucuc

SEQ ID NO: 1377825 - RNA, 19 nt, Human
ugacucgguuccuugucag

SEQ ID NO: 1377826 - RNA, 23 nt, Human
ugaucuuucuuaugaagaauuug

SEQ ID NO: 1377827 - RNA, 19 nt, Human
uucauaagguuucucucca

SEQ ID NO: 1377828 - RNA, 23 nt, Human
uucccacacucaguacauaugga

SEQ ID NO: 1377829 - RNA, 26 nt, Human
uucucauguguaaugagguuggaauu

SEQ ID NO: 1377830 - RNA, 24 nt, Human
uucucugaugcacugugagugcug

SEQ ID NO: 1377831 - RNA, 19 nt, Human
uuuucugcugcaugcgugc

SEQ ID NO: 1377832 - RNA, 22 nt, Human
aaaaaaggaaaaaguggaaaag

SEQ ID NO: 1377833 - RNA, 24 nt, Human
aaaaaaggaaaaaguggaaaagaa

SEQ ID NO: 1377834 - RNA, 24 nt, Human
aaaaaauaaacacaauaaacaccc

SEQ ID NO: 1377835 - RNA, 22 nt, Human
aaaaacaacucaaaaacccucc

SEQ ID NO: 1377836 - RNA, 23 nt, Human
aaaaacacaguugauugacaauc

SEQ ID NO: 1377837 - RNA, 23 nt, Human
aaaaaggaaaaaguggaaaagaa

SEQ ID NO: 1377838 - RNA, 19 nt, Human
aaacaccccuggcaucuuu

SEQ ID NO: 1377839 - RNA, 23 nt, Human
aaacaguuuuuaucuuuguucau

SEQ ID NO: 1377840 - RNA, 18 nt, Human
aacauccccacgaugaca

SEQ ID NO: 1377841 - RNA, 18 nt, Human
aaccccacugacaacgcc

SEQ ID NO: 1377842 - RNA, 19 nt, Human
aacucaaaaacccuccaaa

SEQ ID NO: 1377843 - RNA, 21 nt, Human
aacucaaaaacccuccaaaca

SEQ ID NO: 1377844 - RNA, 22 nt, Human
aacucaaaaacccuccaaacag

SEQ ID NO: 1377845 - RNA, 23 nt, Human
aaggaaaaaguggaaaagaaaau

SEQ ID NO: 1377846 - RNA, 27 nt, Human
aaggaaaaaguggaaaagaagggaccc

SEQ ID NO: 1377847 - RNA, 22 nt, Human
aaggaaggcaucugggcagggc

SEQ ID NO: 1377848 - RNA, 19 nt, Human
aaggggcuuauuucacugg

SEQ ID NO: 1377849 - RNA, 28 nt, Human
accccacccaacaacauaagaaaaacaa

SEQ ID NO: 1377850 - RNA, 18 nt, Human
agaaggcucugagggcuc

SEQ ID NO: 1377851 - RNA, 22 nt, Human
agaccaagcccaccagguuggc

SEQ ID NO: 1377852 - RNA, 25 nt, Human
agaugaucaaguaaagauuuaaaac

SEQ ID NO: 1377853 - RNA, 21 nt, Human
aggaaggcaucugggcagggc

SEQ ID NO: 1377854 - RNA, 21 nt, Human
aggcaucuuccuccugcagcc

SEQ ID NO: 1377855 - RNA, 23 nt, Human
auaaauaaauaucuucuucuuuc

SEQ ID NO: 1377856 - RNA, 21 nt, Human
auaccccacccaacaacauaa

SEQ ID NO: 1377857 - RNA, 23 nt, Human
caaaacccgccacuaucaacaaa

SEQ ID NO: 1377858 - RNA, 20 nt, Human
caacauaagaaaaacaacuc

SEQ ID NO: 1377859 - RNA, 23 nt, Human
cacagagagagagaaaaaaggaa

SEQ ID NO: 1377860 - RNA, 24 nt, Human
cacagagagagagaaaaaaggaaa

SEQ ID NO: 1377861 - RNA, 22 nt, Human
caggcaucuuccuccugcagcc

SEQ ID NO: 1377862 - RNA, 18 nt, Human
caguuuccaguacaagga

SEQ ID NO: 1377863 - RNA, 23 nt, Human
caucccuuguuaagaaaugacuc

SEQ ID NO: 1377864 - RNA, 23 nt, Human
cauggacccugggaccgucccuu

SEQ ID NO: 1377865 - RNA, 24 nt, Human
ccaccagguuggcucugauuacac

SEQ ID NO: 1377866 - RNA, 22 nt, Human
cccacccaacaacauaagaaaa

SEQ ID NO: 1377867 - RNA, 31 nt, Human
ccccacccaacaacauaagaaaaacaacucc

SEQ ID NO: 1377868 - RNA, 18 nt, Human
ccccucacagggccacac

SEQ ID NO: 1377869 - RNA, 22 nt, Human
ccccugcggagagcaugagggc

SEQ ID NO: 1377870 - RNA, 20 nt, Human
ccgcagccaauggagcacac

SEQ ID NO: 1377871 - RNA, 23 nt, Human
ccugcagccgcagccaauggagc

SEQ ID NO: 1377872 - RNA, 19 nt, Human
cuaucaacaaagcuggagg

SEQ ID NO: 1377873 - RNA, 25 nt, Human
cucaaaaacccuccaaacaguuuuu

SEQ ID NO: 1377874 - RNA, 21 nt, Human
cucuuagcagguccuauuuuu

SEQ ID NO: 1377875 - RNA, 18 nt, Human
cugcuugauucucagaaa

SEQ ID NO: 1377876 - RNA, 18 nt, Human
cuuugugagcgccccccu

SEQ ID NO: 1377877 - RNA, 19 nt, Human
gaaaaaguggaaaagaaaa

SEQ ID NO: 1377878 - RNA, 22 nt, Human
gaggggucaggugguccaggug

SEQ ID NO: 1377879 - RNA, 23 nt, Human
gccaugaaaagccuuuuaaugac

SEQ ID NO: 1377880 - RNA, 18 nt, Human
gggcagggcccuuuggcu

SEQ ID NO: 1377881 - RNA, 18 nt, Human
gguccagguggggcucug

SEQ ID NO: 1377882 - RNA, 24 nt, Human
gucuacguugccacaugugucgcu

SEQ ID NO: 1377883 - RNA, 18 nt, Human
uaagaaaaacaacucaaa

SEQ ID NO: 1377884 - RNA, 24 nt, Human
uaaggacaguuccucuccuccccc

SEQ ID NO: 1377885 - RNA, 19 nt, Human
uacaaggaaggcaucuggg

SEQ ID NO: 1377886 - RNA, 19 nt, Human
uagaauggaaaaugucucu

SEQ ID NO: 1377887 - RNA, 26 nt, Human
uagcauggacccugggaccgucccuu

SEQ ID NO: 1377888 - RNA, 24 nt, Human
uauaaauaaauaucuucuucuuuc

SEQ ID NO: 1377889 - RNA, 27 nt, Human
uaucccaagaggcaucccuuguuaaga

SEQ ID NO: 1377890 - RNA, 20 nt, Human
ucaggugaucacgaaggggc

SEQ ID NO: 1377891 - RNA, 20 nt, Human
ucaggugguccagguggggc

SEQ ID NO: 1377892 - RNA, 18 nt, Human
uccccacgaugacagggg

SEQ ID NO: 1377893 - RNA, 21 nt, Human
uccccaugccccagacuuuau

SEQ ID NO: 1377894 - RNA, 24 nt, Human
uccccugaccuuuaaaaauccacc

SEQ ID NO: 1377895 - RNA, 19 nt, Human
uccucccccagaaggcucu

SEQ ID NO: 1377896 - RNA, 18 nt, Human
ucugcacuccccaugccc

SEQ ID NO: 1377897 - RNA, 21 nt, Human
ugacucauaaaauaaccuucc

SEQ ID NO: 1377898 - RNA, 26 nt, Human
ugccccagacuuuauuccccugaccu

SEQ ID NO: 1377899 - RNA, 20 nt, Human
ugccugugcaguucaguaac

SEQ ID NO: 1377900 - RNA, 21 nt, Human
uggaaaaugucucuuagcagg

SEQ ID NO: 1377901 - RNA, 20 nt, Human
uggcaucacagguauaaaua

SEQ ID NO: 1377902 - RNA, 22 nt, Human
uggcaucacagguauaaauaaa

SEQ ID NO: 1377903 - RNA, 23 nt, Human
uggugacaguugaaggcuguccu

SEQ ID NO: 1377904 - RNA, 22 nt, Human
uguacaaaacccgccacuauca

SEQ ID NO: 1377905 - RNA, 23 nt, Human
ugugcugcuacacaauuaugcug

SEQ ID NO: 1377906 - RNA, 18 nt, Human
uguggugacaguugaagg

SEQ ID NO: 1377907 - RNA, 20 nt, Human
uguggugacaguugaaggcu

SEQ ID NO: 1377908 - RNA, 20 nt, Human
uguucaaaaacacaguugau

SEQ ID NO: 1377909 - RNA, 22 nt, Human
uucaaaacuuuccaacuggucu

SEQ ID NO: 1377910 - RNA, 24 nt, Human
uuccccugaccuuuaaaaauccac

SEQ ID NO: 1377911 - RNA, 20 nt, Human
uucuccuggccacaucccgu

SEQ ID NO: 1377912 - RNA, 23 nt, Human
uugcauuuuuuaacaaauaauuu

SEQ ID NO: 1377913 - RNA, 18 nt, Human
uuuccaguacaaggaagg

SEQ ID NO: 1377914 - RNA, 20 nt, Human
aaaaauaacuugcugaagac

SEQ ID NO: 1377915 - RNA, 24 nt, Human
aaagugcugagauuacagguguga

SEQ ID NO: 1377916 - RNA, 24 nt, Human
aaagugcugggauuacaggcguga

SEQ ID NO: 1377917 - RNA, 22 nt, Human
aaccucuuccucaauccuccug

SEQ ID NO: 1377918 - RNA, 18 nt, Human
aacugaguccagaacuga

SEQ ID NO: 1377919 - RNA, 23 nt, Human
aagaggagguggagaagggggac

SEQ ID NO: 1377920 - RNA, 26 nt, Human
aagugcugagauuacaggugugagcc

SEQ ID NO: 1377921 - RNA, 19 nt, Human
aagugcugggauuacaggc

SEQ ID NO: 1377922 - RNA, 19 nt, Human
aagugcugggauuacaggc

SEQ ID NO: 1377923 - RNA, 26 nt, Human
aagugcugggauuacaggcgugagcc

SEQ ID NO: 1377924 - RNA, 23 nt, Human
acacaccaacccuggaggcaugu

SEQ ID NO: 1377925 - RNA, 20 nt, Human
acaccaacccuggaggcaug

SEQ ID NO: 1377926 - RNA, 19 nt, Human
acaggcgcccgccaccacg

SEQ ID NO: 1377927 - RNA, 24 nt, Human
accauguuggccaggauugucucg

SEQ ID NO: 1377928 - RNA, 24 nt, Human
accguguugccuaagcuggucucg

SEQ ID NO: 1377929 - RNA, 21 nt, Human
accucuuccucaauccuccug

SEQ ID NO: 1377930 - RNA, 21 nt, Human
accuugucauccaccugccuc

SEQ ID NO: 1377931 - RNA, 18 nt, Human
acgggguuucaccauguu

SEQ ID NO: 1377932 - RNA, 23 nt, Human
acgggguuucaccauguuggcca

SEQ ID NO: 1377933 - RNA, 24 nt, Human
acgggguuucaccauguuggccag

SEQ ID NO: 1377934 - RNA, 21 nt, Human
agacaagggaaacugagucca

SEQ ID NO: 1377935 - RNA, 19 nt, Human
agacuacaagcgugugcca

SEQ ID NO: 1377936 - RNA, 19 nt, Human
agagaugggguuucaccgu

SEQ ID NO: 1377937 - RNA, 23 nt, Human
agaggagguggagaaggcuuggg

SEQ ID NO: 1377938 - RNA, 23 nt, Human
agauuacaggugugagccacugc

SEQ ID NO: 1377939 - RNA, 18 nt, Human
agcucccucccucuggag

SEQ ID NO: 1377940 - RNA, 20 nt, Human
agcucccucccucuggagga

SEQ ID NO: 1377941 - RNA, 24 nt, Human
agcuggucucgaacuccuaggcuc

SEQ ID NO: 1377942 - RNA, 22 nt, Human
aggaaacgacucaacgcgcagc

SEQ ID NO: 1377943 - RNA, 19 nt, Human
aggaggaggcgagccgcag

SEQ ID NO: 1377944 - RNA, 25 nt, Human
aggcuggagugcaguggcgcgaucu

SEQ ID NO: 1377945 - RNA, 18 nt, Human
agggagggggaggagaga

SEQ ID NO: 1377946 - RNA, 18 nt, Human
aguagcuggggcuacagg

SEQ ID NO: 1377947 - RNA, 22 nt, Human
aguccagaacugaaugagaagc

SEQ ID NO: 1377948 - RNA, 24 nt, Human
agucccgcgguggggacuguggga

SEQ ID NO: 1377949 - RNA, 20 nt, Human
agugcaguggcgcgaucucg

SEQ ID NO: 1377950 - RNA, 23 nt, Human
agugcaguggcgcgaucucggcu

SEQ ID NO: 1377951 - RNA, 24 nt, Human
agugcaguggcgcgaucucggcuc

SEQ ID NO: 1377952 - RNA, 20 nt, Human
agugugauggcgugaucucg

SEQ ID NO: 1377953 - RNA, 22 nt, Human
agugugauggcgugaucucggc

SEQ ID NO: 1377954 - RNA, 24 nt, Human
auauuuguauuuuuaguagagacg

SEQ ID NO: 1377955 - RNA, 21 nt, Human
auccuccugcuucagccuccc

SEQ ID NO: 1377956 - RNA, 21 nt, Human
auggccggagucgggcgaagc

SEQ ID NO: 1377957 - RNA, 18 nt, Human
augggguuucaccguguu

SEQ ID NO: 1377958 - RNA, 19 nt, Human
augggguuucaccguguug

SEQ ID NO: 1377959 - RNA, 30 nt, Human
auuauuucgugugugugugugugugugugg

SEQ ID NO: 1377960 - RNA, 21 nt, Human
auucuccugccucagccuccc

SEQ ID NO: 1377961 - RNA, 21 nt, Human
auuuccucagcuuuucugcua

SEQ ID NO: 1377962 - RNA, 24 nt, Human
caaagugcugagauuacaggugug

SEQ ID NO: 1377963 - RNA, 24 nt, Human
caaagugcugggauuacaggcgug

SEQ ID NO: 1377964 - RNA, 22 nt, Human
caagcaauucuccugccucagc

SEQ ID NO: 1377965 - RNA, 20 nt, Human
caaugcgcccuccuccgccu

SEQ ID NO: 1377966 - RNA, 18 nt, Human
caccauguuggccaggau

SEQ ID NO: 1377967 - RNA, 24 nt, Human
caccauguuggccaggauugucuc

SEQ ID NO: 1377968 - RNA, 24 nt, Human
caccguguugccuaagcuggucuc

SEQ ID NO: 1377969 - RNA, 23 nt, Human
caccugccucggccucccaaagu

SEQ ID NO: 1377970 - RNA, 18 nt, Human
caccugucuaauuuuugu

SEQ ID NO: 1377971 - RNA, 24 nt, Human
caccuugucauccaccugccucgg

SEQ ID NO: 1377972 - RNA, 23 nt, Human
caccuugucauccaccugccucu

SEQ ID NO: 1377973 - RNA, 22 nt, Human
caccuuucccuucuccucucuc

SEQ ID NO: 1377974 - RNA, 19 nt, Human
cagacuacaagcgugugcc

SEQ ID NO: 1377975 - RNA, 21 nt, Human
cagccucccgaguagcugggg

SEQ ID NO: 1377976 - RNA, 19 nt, Human
cagggagguagguugucau

SEQ ID NO: 1377977 - RNA, 19 nt, Human
caguagaagauuccacauc

SEQ ID NO: 1377978 - RNA, 23 nt, Human
caguagaagauuccacaucugga

SEQ ID NO: 1377979 - RNA, 23 nt, Human
caguuugccccuuuagcccucca

SEQ ID NO: 1377980 - RNA, 19 nt, Human
cauccuccaucaccaggcu

SEQ ID NO: 1377981 - RNA, 21 nt, Human
ccaaagugcugagauuacagg

SEQ ID NO: 1377982 - RNA, 21 nt, Human
ccaaagugcugagauuacagg

SEQ ID NO: 1377983 - RNA, 24 nt, Human
ccaaagugcugagauuacaggugu

SEQ ID NO: 1377984 - RNA, 20 nt, Human
ccaaagugcugggauuacag

SEQ ID NO: 1377985 - RNA, 22 nt, Human
ccaaagugcugggauuacaggc

SEQ ID NO: 1377986 - RNA, 22 nt, Human
ccaaagugcugggauuacaggc

SEQ ID NO: 1377987 - RNA, 24 nt, Human
ccaaagugcugggauuacaggcgu

SEQ ID NO: 1377988 - RNA, 18 nt, Human
ccacugcgcccagccuaa

SEQ ID NO: 1377989 - RNA, 18 nt, Human
ccacugcgcccagccuaa

SEQ ID NO: 1377990 - RNA, 19 nt, Human
ccacugcgcccagccuaau

SEQ ID NO: 1377991 - RNA, 24 nt, Human
cccccucuuccucacuucccugua

SEQ ID NO: 1377992 - RNA, 24 nt, Human
cccgaguagcuggggcuacaggcg

SEQ ID NO: 1377993 - RNA, 24 nt, Human
cccgcgguggggacugugggaggc

SEQ ID NO: 1377994 - RNA, 20 nt, Human
cccggguucaagcaauucuc

SEQ ID NO: 1377995 - RNA, 23 nt, Human
cccggguucaagcaauucuccug

SEQ ID NO: 1377996 - RNA, 24 nt, Human
ccgcccggguucaagcaauucucc

SEQ ID NO: 1377997 - RNA, 25 nt, Human
ccgccgcccggguucaagcaauucu

SEQ ID NO: 1377998 - RNA, 18 nt, Human
ccgccgcugccgccgcca

SEQ ID NO: 1377999 - RNA, 24 nt, Human
ccuaggcucaagcaaugcgcccuc

SEQ ID NO: 1378000 - RNA, 20 nt, Human
ccuaggcugcagugugaugg

SEQ ID NO: 1378001 - RNA, 26 nt, Human
ccuccugcuucagccucccaaguagc

SEQ ID NO: 1378002 - RNA, 23 nt, Human
ccugccucagccucccgaguagc

SEQ ID NO: 1378003 - RNA, 24 nt, Human
ccugccucggccucccaaagugcu

SEQ ID NO: 1378004 - RNA, 26 nt, Human
cgcccucgauccccucgccgcggucc

SEQ ID NO: 1378005 - RNA, 22 nt, Human
cgccgcggccuccaaccaccgg

SEQ ID NO: 1378006 - RNA, 24 nt, Human
cgcucugucaccuaggcugcagug

SEQ ID NO: 1378007 - RNA, 23 nt, Human
cgcuuugcgaggggaaacgaucc

SEQ ID NO: 1378008 - RNA, 19 nt, Human
cggccacccuggcaauucc

SEQ ID NO: 1378009 - RNA, 18 nt, Human
cgggagggauccgcggug

SEQ ID NO: 1378010 - RNA, 26 nt, Human
cguacgcgugcgggcugacgugcgcg

SEQ ID NO: 1378011 - RNA, 23 nt, Human
cgugugugugugugugugugugu

SEQ ID NO: 1378012 - RNA, 22 nt, Human
cguguguguguguguguguguu

SEQ ID NO: 1378013 - RNA, 21 nt, Human
cuaauuccacuuuacauauau

SEQ ID NO: 1378014 - RNA, 23 nt, Human
cuaggcugcagugugauggcgug

SEQ ID NO: 1378015 - RNA, 24 nt, Human
cucacuucccuguacucucaucgc

SEQ ID NO: 1378016 - RNA, 24 nt, Human
cucagccucccgaguagcuggggc

SEQ ID NO: 1378017 - RNA, 21 nt, Human
cucccaaagugcugagauuac

SEQ ID NO: 1378018 - RNA, 19 nt, Human
cuccugccccugcagccgc

SEQ ID NO: 1378019 - RNA, 23 nt, Human
cucgcuuugucgccaggcuggag

SEQ ID NO: 1378020 - RNA, 21 nt, Human
cugccgccgcugccgccgcca

SEQ ID NO: 1378021 - RNA, 23 nt, Human
cugccucagccucccgaguagcu

SEQ ID NO: 1378022 - RNA, 23 nt, Human
cugcuucagccucccaaguagcu

SEQ ID NO: 1378023 - RNA, 19 nt, Human
cuuugucgccaggcuggag

SEQ ID NO: 1378024 - RNA, 20 nt, Human
gaacgcgaggagggaggagu

SEQ ID NO: 1378025 - RNA, 18 nt, Human
gaccucugggagagcagu

SEQ ID NO: 1378026 - RNA, 24 nt, Human
gacggagucucgcuuugucgccag

SEQ ID NO: 1378027 - RNA, 24 nt, Human
gagacgggguuucaccauguuggc

SEQ ID NO: 1378028 - RNA, 23 nt, Human
gagaugggguuucaccguguugc

SEQ ID NO: 1378029 - RNA, 21 nt, Human
gagcugccgcggccacucugc

SEQ ID NO: 1378030 - RNA, 22 nt, Human
gaggagugggagguugggggug

SEQ ID NO: 1378031 - RNA, 20 nt, Human
gagggagggggaggagagaa

SEQ ID NO: 1378032 - RNA, 22 nt, Human
gaugggguuucaccguguugcc

SEQ ID NO: 1378033 - RNA, 18 nt, Human
gauuacaggcgugagcca

SEQ ID NO: 1378034 - RNA, 22 nt, Human
gauuacaggcgugagccaccgc

SEQ ID NO: 1378035 - RNA, 22 nt, Human
gauuacaggcgugagccaccgc

SEQ ID NO: 1378036 - RNA, 18 nt, Human
gauuacaggugugagcca

SEQ ID NO: 1378037 - RNA, 22 nt, Human
gauuacaggugugagccacugc

SEQ ID NO: 1378038 - RNA, 21 nt, Human
gcauguuuggaguugccuaau

SEQ ID NO: 1378039 - RNA, 19 nt, Human
gccaggaauggaacagucc

SEQ ID NO: 1378040 - RNA, 22 nt, Human
gcgagccgcagcgccgcggcga

SEQ ID NO: 1378041 - RNA, 20 nt, Human
gcgcuaggccgcccucgauc

SEQ ID NO: 1378042 - RNA, 21 nt, Human
gcgguugguggccgugcgggc

SEQ ID NO: 1378043 - RNA, 18 nt, Human
gcuaggcgcccuuagcuc

SEQ ID NO: 1378044 - RNA, 19 nt, Human
ggacccagggaagcggagg

SEQ ID NO: 1378045 - RNA, 21 nt, Human
ggagaacugggcgaggagguu

SEQ ID NO: 1378046 - RNA, 18 nt, Human
ggaggagagaagaggagg

SEQ ID NO: 1378047 - RNA, 23 nt, Human
ggagggggaggagagaagaggag

SEQ ID NO: 1378048 - RNA, 19 nt, Human
ggagguucccgugggugag

SEQ ID NO: 1378049 - RNA, 18 nt, Human
ggagugggagguuggggg

SEQ ID NO: 1378050 - RNA, 19 nt, Human
ggccacucugcugccgccg

SEQ ID NO: 1378051 - RNA, 24 nt, Human
ggcggcgguugguggccgugcggg

SEQ ID NO: 1378052 - RNA, 21 nt, Human
ggcugcuuuggcggcgguugg

SEQ ID NO: 1378053 - RNA, 20 nt, Human
gggaagcggaggagccuggc

SEQ ID NO: 1378054 - RNA, 19 nt, Human
gggagguugggggugucgc

SEQ ID NO: 1378055 - RNA, 23 nt, Human
gggguuucaccauguuggccagg

SEQ ID NO: 1378056 - RNA, 22 nt, Human
ggguuucaccauguuggccagg

SEQ ID NO: 1378057 - RNA, 21 nt, Human
gguggugguuggugggagcag

SEQ ID NO: 1378058 - RNA, 19 nt, Human
gguuggugggagcagccag

SEQ ID NO: 1378059 - RNA, 19 nt, Human
guagacacucguacgcgug

SEQ ID NO: 1378060 - RNA, 23 nt, Human
guagagacgggguuucaccaugu

SEQ ID NO: 1378061 - RNA, 19 nt, Human
guagagaugggguuucacc

SEQ ID NO: 1378062 - RNA, 19 nt, Human
guagagaugggguuucacc

SEQ ID NO: 1378063 - RNA, 24 nt, Human
gucucgcuuugucgccaggcugga

SEQ ID NO: 1378064 - RNA, 29 nt, Human
gugcuggcggcggcugcuuuggcggcgac

SEQ ID NO: 1378065 - RNA, 23 nt, Human
uaauauuuguauuuuuaguagag

SEQ ID NO: 1378066 - RNA, 24 nt, Human
uaauauuuguauuuuuaguagaga

SEQ ID NO: 1378067 - RNA, 25 nt, Human
uaauuuuugugucuuuuuguagaga

SEQ ID NO: 1378068 - RNA, 24 nt, Human
uacaggcgugagccaccgcgccca

SEQ ID NO: 1378069 - RNA, 19 nt, Human
uacaggugugagccacugc

SEQ ID NO: 1378070 - RNA, 24 nt, Human
uacaggugugagccacugcgccca

SEQ ID NO: 1378071 - RNA, 22 nt, Human
uagagacgggguuucaccaugu

SEQ ID NO: 1378072 - RNA, 24 nt, Human
uagcucccucccucuggaggagcu

SEQ ID NO: 1378073 - RNA, 19 nt, Human
uagggugggggugcuggcg

SEQ ID NO: 1378074 - RNA, 20 nt, Human
uagggugggggugcuggcgg

SEQ ID NO: 1378075 - RNA, 24 nt, Human
uaguagagacgggguuucaccaug

SEQ ID NO: 1378076 - RNA, 25 nt, Human
uaguagagacgggguuucaccaugu

SEQ ID NO: 1378077 - RNA, 18 nt, Human
ucacugcaacuuccgccg

SEQ ID NO: 1378078 - RNA, 21 nt, Human
ucacugcaacuuccgccgccc

SEQ ID NO: 1378079 - RNA, 24 nt, Human
ucacugcaacuuccgccgcccggg

SEQ ID NO: 1378080 - RNA, 21 nt, Human
ucagccucccaaguagcucag

SEQ ID NO: 1378081 - RNA, 23 nt, Human
ucagccucccgaguagcuggggc

SEQ ID NO: 1378082 - RNA, 18 nt, Human
uccagaacugaaugagaa

SEQ ID NO: 1378083 - RNA, 23 nt, Human
ucccaaagugcugagauuacagg

SEQ ID NO: 1378084 - RNA, 24 nt, Human
ucccaaagugcugggauuacaggc

SEQ ID NO: 1378085 - RNA, 25 nt, Human
ucccagugucgguugcgggauccgc

SEQ ID NO: 1378086 - RNA, 19 nt, Human
ucccauggaggaggaggcg

SEQ ID NO: 1378087 - RNA, 24 nt, Human
ucccgaguagcuggggcuacaggc

SEQ ID NO: 1378088 - RNA, 20 nt, Human
ucccuguacucucaucgcuc

SEQ ID NO: 1378089 - RNA, 20 nt, Human
uccgacacggugaguagaac

SEQ ID NO: 1378090 - RNA, 18 nt, Human
uccuaggcucaagcaaug

SEQ ID NO: 1378091 - RNA, 21 nt, Human
uccuccaucaccaggcugucu

SEQ ID NO: 1378092 - RNA, 21 nt, Human
uccuccgccucccaaagugcu

SEQ ID NO: 1378093 - RNA, 18 nt, Human
uccugggcuuucugggag

SEQ ID NO: 1378094 - RNA, 24 nt, Human
ucgccaggcuggagugcaguggcg

SEQ ID NO: 1378095 - RNA, 20 nt, Human
ucgcuaggcgcccuuagcuc

SEQ ID NO: 1378096 - RNA, 18 nt, Human
ucggccucccaaagugcu

SEQ ID NO: 1378097 - RNA, 21 nt, Human
ucucccggaccuggaccucug

SEQ ID NO: 1378098 - RNA, 24 nt, Human
ucuccugccucagccucccgagua

SEQ ID NO: 1378099 - RNA, 23 nt, Human
ucucgaacuccuaggcucaagca

SEQ ID NO: 1378100 - RNA, 19 nt, Human
ucucgcucugucaccuagg

SEQ ID NO: 1378101 - RNA, 22 nt, Human
ucucgcucugucaccuaggcug

SEQ ID NO: 1378102 - RNA, 26 nt, Human
ucucgcucugucaccuaggcugcagu

SEQ ID NO: 1378103 - RNA, 27 nt, Human
ucucgcucugucaccuaggcugcagug

SEQ ID NO: 1378104 - RNA, 21 nt, Human
ucucgcuuugucgccaggcug

SEQ ID NO: 1378105 - RNA, 22 nt, Human
ucucgcuuugucgccaggcugg

SEQ ID NO: 1378106 - RNA, 23 nt, Human
ucucgcuuugucgccaggcugga

SEQ ID NO: 1378107 - RNA, 22 nt, Human
ucucucagcgauugaauccugg

SEQ ID NO: 1378108 - RNA, 20 nt, Human
ucuuucuuuuuuugagacag

SEQ ID NO: 1378109 - RNA, 21 nt, Human
ucuuuuuuugagacagggucu

SEQ ID NO: 1378110 - RNA, 26 nt, Human
ugaaaaauauauccucauuaaucuaa

SEQ ID NO: 1378111 - RNA, 22 nt, Human
ugagacagggucucgcucuguc

SEQ ID NO: 1378112 - RNA, 19 nt, Human
ugagauuacaggugugagc

SEQ ID NO: 1378113 - RNA, 21 nt, Human
ugagauuacaggugugagcca

SEQ ID NO: 1378114 - RNA, 22 nt, Human
ugagauuacaggugugagccac

SEQ ID NO: 1378115 - RNA, 22 nt, Human
ugagauuacaggugugagccac

SEQ ID NO: 1378116 - RNA, 24 nt, Human
ugagauuacaggugugagccacug

SEQ ID NO: 1378117 - RNA, 22 nt, Human
ugcaguggcgcgaucucggcuc

SEQ ID NO: 1378118 - RNA, 24 nt, Human
ugcagugugauggcgugaucucgg

SEQ ID NO: 1378119 - RNA, 24 nt, Human
ugccuaagcuggucucgaacuccu

SEQ ID NO: 1378120 - RNA, 24 nt, Human
ugccucagccucccgaguagcugg

SEQ ID NO: 1378121 - RNA, 21 nt, Human
ugccucggccucccaaagugc

SEQ ID NO: 1378122 - RNA, 24 nt, Human
ugccucggccucccaaagugcugg

SEQ ID NO: 1378123 - RNA, 20 nt, Human
ugcgaggggaaacgauccca

SEQ ID NO: 1378124 - RNA, 22 nt, Human
ugcgcccuccuccgccucccaa

SEQ ID NO: 1378125 - RNA, 19 nt, Human
ugcgcuggagccggcuuga

SEQ ID NO: 1378126 - RNA, 24 nt, Human
ugcugagauuacaggugugagcca

SEQ ID NO: 1378127 - RNA, 18 nt, Human
ugcuggcggcggcugcuu

SEQ ID NO: 1378128 - RNA, 24 nt, Human
ugcugggauuacaggcgugagcca

SEQ ID NO: 1378129 - RNA, 20 nt, Human
ugcuucagccucccaaguag

SEQ ID NO: 1378130 - RNA, 24 nt, Human
ugcuucagccucccaaguagcuca

SEQ ID NO: 1378131 - RNA, 23 nt, Human
uggagugcaguggcgcgaucucg

SEQ ID NO: 1378132 - RNA, 24 nt, Human
uggagugcaguggcgcgaucucgg

SEQ ID NO: 1378133 - RNA, 23 nt, Human
uggcggccacccccucuuccuca

SEQ ID NO: 1378134 - RNA, 21 nt, Human
uggcggcgguugguggccgug

SEQ ID NO: 1378135 - RNA, 20 nt, Human
ugggagagcaguggugaaga

SEQ ID NO: 1378136 - RNA, 18 nt, Human
ugggauuacaggcgugag

SEQ ID NO: 1378137 - RNA, 19 nt, Human
ugggauuacaggcgugagc

SEQ ID NO: 1378138 - RNA, 21 nt, Human
ugggauuacaggcgugagcca

SEQ ID NO: 1378139 - RNA, 22 nt, Human
ugggauuacaggcgugagccac

SEQ ID NO: 1378140 - RNA, 23 nt, Human
ugggauuacaggcgugagccacc

SEQ ID NO: 1378141 - RNA, 24 nt, Human
ugggauuacaggcgugagccaccg

SEQ ID NO: 1378142 - RNA, 20 nt, Human
ugggcucgcgccgcugaagg

SEQ ID NO: 1378143 - RNA, 21 nt, Human
uggggcuacaggcgcccgcca

SEQ ID NO: 1378144 - RNA, 22 nt, Human
uggggcuacaggcgcccgccac

SEQ ID NO: 1378145 - RNA, 24 nt, Human
uggggcuacaggcgcccgccacca

SEQ ID NO: 1378146 - RNA, 18 nt, Human
ugggguuucaccguguug

SEQ ID NO: 1378147 - RNA, 19 nt, Human
ugggugagcgcguacggga

SEQ ID NO: 1378148 - RNA, 24 nt, Human
uguagagaugggguuucaccgugu

SEQ ID NO: 1378149 - RNA, 21 nt, Human
uguauuuuuaguagagacggg

SEQ ID NO: 1378150 - RNA, 18 nt, Human
ugugugugugugugugug

SEQ ID NO: 1378151 - RNA, 21 nt, Human
ugugugugugugugugugacg

SEQ ID NO: 1378152 - RNA, 18 nt, Human
uuaguagagacgggguuu

SEQ ID NO: 1378153 - RNA, 22 nt, Human
uuaguagagacgggguuucacc

SEQ ID NO: 1378154 - RNA, 24 nt, Human
uuaguagagacgggguuucaccau

SEQ ID NO: 1378155 - RNA, 21 nt, Human
uucaagcaauucuccugccuc

SEQ ID NO: 1378156 - RNA, 24 nt, Human
uucaagcaauucuccugccucagc

SEQ ID NO: 1378157 - RNA, 24 nt, Human
uuccagucaaacggcaagccagac

SEQ ID NO: 1378158 - RNA, 22 nt, Human
uuccucuccugccccugcagcc

SEQ ID NO: 1378159 - RNA, 22 nt, Human
uugagacagggucucgcucugu

SEQ ID NO: 1378160 - RNA, 23 nt, Human
uugcaaccucuuccucaauccuc

SEQ ID NO: 1378161 - RNA, 18 nt, Human
uuggugggagcagccagc

SEQ ID NO: 1378162 - RNA, 24 nt, Human
uuguagagaugggguuucaccgug

SEQ ID NO: 1378163 - RNA, 23 nt, Human
uuguauuuuuaguagagacgggg

SEQ ID NO: 1378164 - RNA, 19 nt, Human
uuucacacaccaacccugg

SEQ ID NO: 1378165 - RNA, 19 nt, Human
uuucaccauguuggccagg

SEQ ID NO: 1378166 - RNA, 23 nt, Human
uuucugcuaaugucuucuuucuu

SEQ ID NO: 1378167 - RNA, 19 nt, Human
uuucuuuuuuugagacagg

SEQ ID NO: 1378168 - RNA, 25 nt, Human
uuugcaaccucuuccucaauccucc

SEQ ID NO: 1378169 - RNA, 24 nt, Human
uuuguagagaugggguuucaccgu

SEQ ID NO: 1378170 - RNA, 23 nt, Human
uuugucgccaggcuggagugcag

SEQ ID NO: 1378171 - RNA, 24 nt, Human
uuuuuaguagagacgggguuucac

SEQ ID NO: 1378172 - RNA, 23 nt, Human
uuuuuguagagaugggguuucac

SEQ ID NO: 1378173 - RNA, 26 nt, Human
aaaaaaaaaaaacaaaacaaaaccag

SEQ ID NO: 1378174 - RNA, 21 nt, Human
aaaaaaacaaaacaaaaccag

SEQ ID NO: 1378175 - RNA, 19 nt, Human
aaagaagccaauuucaggg

SEQ ID NO: 1378176 - RNA, 22 nt, Human
aaagcagaaaaaaaaacaucau

SEQ ID NO: 1378177 - RNA, 22 nt, Human
aaauacaauucagcacaaaaca

SEQ ID NO: 1378178 - RNA, 18 nt, Human
aacauggugaaacccauc

SEQ ID NO: 1378179 - RNA, 19 nt, Human
aacauggugaaacccaucu

SEQ ID NO: 1378180 - RNA, 20 nt, Human
aacauggugaaacccaucuc

SEQ ID NO: 1378181 - RNA, 20 nt, Human
aaccuugccucauccacccc

SEQ ID NO: 1378182 - RNA, 21 nt, Human
aagcagaaaaaaaaacaggga

SEQ ID NO: 1378183 - RNA, 19 nt, Human
aagcagaaaaaaaaacauc

SEQ ID NO: 1378184 - RNA, 23 nt, Human
aagcagaaaaaaaaacaucauug

SEQ ID NO: 1378185 - RNA, 21 nt, Human
aagcuaaccucauuacaacau

SEQ ID NO: 1378186 - RNA, 19 nt, Human
acaaaacaaaaccagaggc

SEQ ID NO: 1378187 - RNA, 20 nt, Human
acaagagcgaaacuccaccu

SEQ ID NO: 1378188 - RNA, 22 nt, Human
agaaauuuucuucuacaacuaa

SEQ ID NO: 1378189 - RNA, 18 nt, Human
agacaugcaaguauaugg

SEQ ID NO: 1378190 - RNA, 21 nt, Human
agagaagcccaauaaaaagaa

SEQ ID NO: 1378191 - RNA, 18 nt, Human
agagguugcagugaguug

SEQ ID NO: 1378192 - RNA, 22 nt, Human
agagguugcagugaguugagau

SEQ ID NO: 1378193 - RNA, 23 nt, Human
agagguugcagugaguugagauc

SEQ ID NO: 1378194 - RNA, 24 nt, Human
agcacuuugggaggccgaggcggg

SEQ ID NO: 1378195 - RNA, 22 nt, Human
agccuggccaacauggugaaac

SEQ ID NO: 1378196 - RNA, 24 nt, Human
agccuggccaacauggugaaaccc

SEQ ID NO: 1378197 - RNA, 24 nt, Human
agcgccuugcaaagcagaaaaaaa

SEQ ID NO: 1378198 - RNA, 21 nt, Human
aggccgaggcggguggaucac

SEQ ID NO: 1378199 - RNA, 19 nt, Human
aggccgggcacgguggcuc

SEQ ID NO: 1378200 - RNA, 22 nt, Human
aggcggguggaucaccugaggg

SEQ ID NO: 1378201 - RNA, 22 nt, Human
aggcggguggaucaccugaggu

SEQ ID NO: 1378202 - RNA, 24 nt, Human
aggcugagggaggagaaucacuug

SEQ ID NO: 1378203 - RNA, 24 nt, Human
agggaggagaaucacuugaaccug

SEQ ID NO: 1378204 - RNA, 25 nt, Human
agguaaucagcaaauacaauucagc

SEQ ID NO: 1378205 - RNA, 21 nt, Human
auaaaaagaaaagaugggaau

SEQ ID NO: 1378206 - RNA, 19 nt, Human
auaaaagauucuagcgccu

SEQ ID NO: 1378207 - RNA, 25 nt, Human
auaaaagauucuagcgccuugcaaa

SEQ ID NO: 1378208 - RNA, 21 nt, Human
aucaaguuugauaaaauccaa

SEQ ID NO: 1378209 - RNA, 21 nt, Human
augaagcaaagcuaaccucau

SEQ ID NO: 1378210 - RNA, 21 nt, Human
augcucgugggugccuguaau

SEQ ID NO: 1378211 - RNA, 22 nt, Human
auggugagacagcucugggaac

SEQ ID NO: 1378212 - RNA, 19 nt, Human
caaaacaaaaccagaggcc

SEQ ID NO: 1378213 - RNA, 19 nt, Human
caaaauuuucuucugcaga

SEQ ID NO: 1378214 - RNA, 21 nt, Human
caaaccucugaugacuuccaa

SEQ ID NO: 1378215 - RNA, 21 nt, Human
caaauacaauucagcacaaaa

SEQ ID NO: 1378216 - RNA, 26 nt, Human
caaauacaauucagcacaaaacacaa

SEQ ID NO: 1378217 - RNA, 23 nt, Human
caacauggugaaacccaucucua

SEQ ID NO: 1378218 - RNA, 25 nt, Human
caacuaaaaugagguuuggagucca

SEQ ID NO: 1378219 - RNA, 20 nt, Human
caccugaggucuggaauucg

SEQ ID NO: 1378220 - RNA, 22 nt, Human
caccugaggucuggaauucgag

SEQ ID NO: 1378221 - RNA, 19 nt, Human
caccuguaaucccagcacu

SEQ ID NO: 1378222 - RNA, 24 nt, Human
caccuguaaucccagcacuuuggg

SEQ ID NO: 1378223 - RNA, 24 nt, Human
cacuccagcccgggcaacaagagc

SEQ ID NO: 1378224 - RNA, 25 nt, Human
cagcaaauacaauucagcacaaaac

SEQ ID NO: 1378225 - RNA, 24 nt, Human
cagcacuuugggaggccgaggcgg

SEQ ID NO: 1378226 - RNA, 21 nt, Human
cagcccgggcaacaagagcga

SEQ ID NO: 1378227 - RNA, 25 nt, Human
cagcggacgccuccugcgacggucc

SEQ ID NO: 1378228 - RNA, 21 nt, Human
cagcucuuaagaugcuccggg

SEQ ID NO: 1378229 - RNA, 19 nt, Human
cauugcacuccagcccggg

SEQ ID NO: 1378230 - RNA, 21 nt, Human
cauugcacuccagcccgggca

SEQ ID NO: 1378231 - RNA, 22 nt, Human
cauugcacuccagcccgggcaa

SEQ ID NO: 1378232 - RNA, 23 nt, Human
cauugcacuccagcccgggcaac

SEQ ID NO: 1378233 - RNA, 24 nt, Human
cauugcacuccagcccgggcaaca

SEQ ID NO: 1378234 - RNA, 23 nt, Human
cauugcuaagaacugaucugcag

SEQ ID NO: 1378235 - RNA, 18 nt, Human
ccaccucaaaaaaaauaa

SEQ ID NO: 1378236 - RNA, 19 nt, Human
ccagagaagcccaauaaaa

SEQ ID NO: 1378237 - RNA, 20 nt, Human
ccauugcacuccagcccggg

SEQ ID NO: 1378238 - RNA, 21 nt, Human
ccauugcacuccagcccgggc

SEQ ID NO: 1378239 - RNA, 22 nt, Human
ccauugcacuccagcccgggca

SEQ ID NO: 1378240 - RNA, 24 nt, Human
ccauugcacuccagcccgggcaac

SEQ ID NO: 1378241 - RNA, 23 nt, Human
cccauuaaaaaaaaaaaacaaaa

SEQ ID NO: 1378242 - RNA, 20 nt, Human
cccuccacaucccuccccag

SEQ ID NO: 1378243 - RNA, 22 nt, Human
cccucucuuuugucccccauua

SEQ ID NO: 1378244 - RNA, 24 nt, Human
ccggccccuaguugucagcugcgc

SEQ ID NO: 1378245 - RNA, 19 nt, Human
ccucuagaccuugagguca

SEQ ID NO: 1378246 - RNA, 23 nt, Human
ccucuuucuccugcaaaccuugc

SEQ ID NO: 1378247 - RNA, 22 nt, Human
ccuggccaacauggugaaaccc

SEQ ID NO: 1378248 - RNA, 23 nt, Human
ccuggccaacauggugaaaccca

SEQ ID NO: 1378249 - RNA, 19 nt, Human
ccuguaaucccagcuacuu

SEQ ID NO: 1378250 - RNA, 21 nt, Human
ccuguaaucccagcuacuugg

SEQ ID NO: 1378251 - RNA, 22 nt, Human
cgaaacuccaccucaaaaaaaa

SEQ ID NO: 1378252 - RNA, 24 nt, Human
cgagaccagccuggccaacauggu

SEQ ID NO: 1378253 - RNA, 20 nt, Human
cgaggcagcagcuguagagc

SEQ ID NO: 1378254 - RNA, 20 nt, Human
cgaggcggguggaucaccug

SEQ ID NO: 1378255 - RNA, 24 nt, Human
cgaggcggguggaucaccugaggu

SEQ ID NO: 1378256 - RNA, 24 nt, Human
cgcaccuguaaucccagcacuuug

SEQ ID NO: 1378257 - RNA, 19 nt, Human
cgcugagcuaaggaugcag

SEQ ID NO: 1378258 - RNA, 24 nt, Human
cggguggaucaccugaggucugga

SEQ ID NO: 1378259 - RNA, 19 nt, Human
cuccauggucggcauuucc

SEQ ID NO: 1378260 - RNA, 18 nt, Human
cuccggggaugcgcugag

SEQ ID NO: 1378261 - RNA, 24 nt, Human
cucgcaccuguaaucccagcacuu

SEQ ID NO: 1378262 - RNA, 23 nt, Human
cucugucaucuuuuuccccucca

SEQ ID NO: 1378263 - RNA, 23 nt, Human
cuggagggcagagguugcaguga

SEQ ID NO: 1378264 - RNA, 18 nt, Human
cuuacugcagaccucuag

SEQ ID NO: 1378265 - RNA, 19 nt, Human
cuuucccucucuuuugucc

SEQ ID NO: 1378266 - RNA, 19 nt, Human
cuuucccucucuuuugucc

SEQ ID NO: 1378267 - RNA, 21 nt, Human
gacugccuuuuacuacuucau

SEQ ID NO: 1378268 - RNA, 23 nt, Human
gagaucucaccauugcacuccag

SEQ ID NO: 1378269 - RNA, 23 nt, Human
gauauaagaggcaauaaaaagaa

SEQ ID NO: 1378270 - RNA, 18 nt, Human
gaucaccugaggucugga

SEQ ID NO: 1378271 - RNA, 24 nt, Human
gaucaccugaggucuggaauucga

SEQ ID NO: 1378272 - RNA, 21 nt, Human
gauuuauaggggucuuucccu

SEQ ID NO: 1378273 - RNA, 19 nt, Human
gcaaaauuuucuucugcag

SEQ ID NO: 1378274 - RNA, 18 nt, Human
gcaaauacaauucagcac

SEQ ID NO: 1378275 - RNA, 24 nt, Human
gcauuuccagaaaaacaaaggcca

SEQ ID NO: 1378276 - RNA, 24 nt, Human
gcucgugggugccuguaaucccag

SEQ ID NO: 1378277 - RNA, 23 nt, Human
ggcacgguggcucgcaccuguaa

SEQ ID NO: 1378278 - RNA, 18 nt, Human
ggcagagguugcagugag

SEQ ID NO: 1378279 - RNA, 23 nt, Human
ggcagagguugcagugaguugag

SEQ ID NO: 1378280 - RNA, 24 nt, Human
ggccaacauggugaaacccaucuc

SEQ ID NO: 1378281 - RNA, 23 nt, Human
gggagugggagaaauucuccaga

SEQ ID NO: 1378282 - RNA, 20 nt, Human
gggauuagaggagagaagaa

SEQ ID NO: 1378283 - RNA, 24 nt, Human
gggcaugcucgugggugccuguaa

SEQ ID NO: 1378284 - RNA, 23 nt, Human
gguggcucgcaccuguaauccca

SEQ ID NO: 1378285 - RNA, 24 nt, Human
gguggcucgcaccuguaaucccag

SEQ ID NO: 1378286 - RNA, 19 nt, Human
gugggugccuguaauccca

SEQ ID NO: 1378287 - RNA, 20 nt, Human
uaaagcaucuccauggucgg

SEQ ID NO: 1378288 - RNA, 21 nt, Human
uaagaugcuccggggaugcgc

SEQ ID NO: 1378289 - RNA, 21 nt, Human
uaauucuucaaaccucugaug

SEQ ID NO: 1378290 - RNA, 22 nt, Human
uacaacaucuaagcuauuugag

SEQ ID NO: 1378291 - RNA, 19 nt, Human
uagcagaagagcugauagc

SEQ ID NO: 1378292 - RNA, 19 nt, Human
ucaaccaagaaauggcugu

SEQ ID NO: 1378293 - RNA, 23 nt, Human
ucaaccaagaaauggcugucacu

SEQ ID NO: 1378294 - RNA, 19 nt, Human
uccaccucaaaaaaaauaa

SEQ ID NO: 1378295 - RNA, 19 nt, Human
ucuacaacuaaaaugaggu

SEQ ID NO: 1378296 - RNA, 19 nt, Human
ucuccauggucggcauuuc

SEQ ID NO: 1378297 - RNA, 24 nt, Human
ucucuacugaaaauacaaaaaauu

SEQ ID NO: 1378298 - RNA, 18 nt, Human
ucugucaucuuuuucccc

SEQ ID NO: 1378299 - RNA, 24 nt, Human
ucugucaucuuuuuccccuccaca

SEQ ID NO: 1378300 - RNA, 18 nt, Human
ugagaagacucuaaagca

SEQ ID NO: 1378301 - RNA, 19 nt, Human
ugagggaggagaaucacuu

SEQ ID NO: 1378302 - RNA, 20 nt, Human
ugagggaggagaaucacuug

SEQ ID NO: 1378303 - RNA, 24 nt, Human
ugagggaggagaaucacuugaacc

SEQ ID NO: 1378304 - RNA, 23 nt, Human
ugauagcaaaaauaccccauuuc

SEQ ID NO: 1378305 - RNA, 19 nt, Human
ugcaaagcagaaaaaaaaa

SEQ ID NO: 1378306 - RNA, 21 nt, Human
ugcaaagcagaaaaaaaaaca

SEQ ID NO: 1378307 - RNA, 22 nt, Human
ugcacuccagcccgggcaacaa

SEQ ID NO: 1378308 - RNA, 25 nt, Human
ugcacuccagcccgggcaacaagag

SEQ ID NO: 1378309 - RNA, 20 nt, Human
ugccucauccaccccaccuu

SEQ ID NO: 1378310 - RNA, 23 nt, Human
ugccuguaaucccagcuacuugg

SEQ ID NO: 1378311 - RNA, 24 nt, Human
ugccuguaaucccagcuacuuggg

SEQ ID NO: 1378312 - RNA, 19 nt, Human
ugccuuuuacuacuucaua

SEQ ID NO: 1378313 - RNA, 23 nt, Human
uggaauucgagaccagccuggcc

SEQ ID NO: 1378314 - RNA, 24 nt, Human
uggagggcagagguugcagugagu

SEQ ID NO: 1378315 - RNA, 24 nt, Human
uggaucaccugaggucuggaauuc

SEQ ID NO: 1378316 - RNA, 23 nt, Human
uggccaacauggugaaacccauc

SEQ ID NO: 1378317 - RNA, 21 nt, Human
uggcucgcaccuguaauccca

SEQ ID NO: 1378318 - RNA, 22 nt, Human
uggcucgcaccuguaaucccag

SEQ ID NO: 1378319 - RNA, 24 nt, Human
uggcucgcaccuguaaucccagca

SEQ ID NO: 1378320 - RNA, 23 nt, Human
ugggaggccgaggcggguggauc

SEQ ID NO: 1378321 - RNA, 24 nt, Human
ugggaggccgaggcggguggauca

SEQ ID NO: 1378322 - RNA, 24 nt, Human
ugggaggcugagggaggagaauca

SEQ ID NO: 1378323 - RNA, 21 nt, Human
ugucagcugcgcucagcucuu

SEQ ID NO: 1378324 - RNA, 24 nt, Human
uguccuuauaccugaaaacagcuu

SEQ ID NO: 1378325 - RNA, 24 nt, Human
uuauauauagauuuauaggggucu

SEQ ID NO: 1378326 - RNA, 25 nt, Human
uucaaaccucugaugacuuccaacc

SEQ ID NO: 1378327 - RNA, 19 nt, Human
uugaaaaauuuaaggagaa

SEQ ID NO: 1378328 - RNA, 21 nt, Human
uugaaaaauuuaaggagaacu

SEQ ID NO: 1378329 - RNA, 20 nt, Human
uugcaaagcagaaaaaaaaa

SEQ ID NO: 1378330 - RNA, 20 nt, Human
uugcaauggugagacagcuc

SEQ ID NO: 1378331 - RNA, 19 nt, Human
uugcagugaguugagaucu

SEQ ID NO: 1378332 - RNA, 22 nt, Human
uugcagugaguugagaucucac

SEQ ID NO: 1378333 - RNA, 25 nt, Human
uugggaggccgaggcggguggauca

SEQ ID NO: 1378334 - RNA, 25 nt, Human
uugggaggcugagggaggagaauca

SEQ ID NO: 1378335 - RNA, 20 nt, Human
uuuaaggagaacuucugagg

SEQ ID NO: 1378336 - RNA, 19 nt, Human
uuugauaaaauccaaguuc

SEQ ID NO: 1378337 - RNA, 21 nt, Human
aaaucccaagugucaggcccc

SEQ ID NO: 1378338 - RNA, 21 nt, Human
aaccccaacccacugccccuc

SEQ ID NO: 1378339 - RNA, 19 nt, Human
aagaggaggugcccaggac

SEQ ID NO: 1378340 - RNA, 23 nt, Human
aaggccccuccaguagccacacu

SEQ ID NO: 1378341 - RNA, 23 nt, Human
aaggggcaggagggaggcaaaga

SEQ ID NO: 1378342 - RNA, 27 nt, Human
aagugucaggcccccggaguccaucac

SEQ ID NO: 1378343 - RNA, 21 nt, Human
acccaggaacagccccucaac

SEQ ID NO: 1378344 - RNA, 19 nt, Human
acugccccucuuuggcagc

SEQ ID NO: 1378345 - RNA, 23 nt, Human
acugcgagcccggggucucagcu

SEQ ID NO: 1378346 - RNA, 20 nt, Human
agaaaaaggcaccaaggaca

SEQ ID NO: 1378347 - RNA, 19 nt, Human
agacccagggcagaggcga

SEQ ID NO: 1378348 - RNA, 18 nt, Human
agacccagggucuccagg

SEQ ID NO: 1378349 - RNA, 19 nt, Human
agcaggaaaggggcaggag

SEQ ID NO: 1378350 - RNA, 18 nt, Human
aggagggaggcaaagagg

SEQ ID NO: 1378351 - RNA, 20 nt, Human
aggcaaagaggaggugcccg

SEQ ID NO: 1378352 - RNA, 23 nt, Human
aggcaccacauggggcggcagua

SEQ ID NO: 1378353 - RNA, 23 nt, Human
aggcagccaggggccagcuccag

SEQ ID NO: 1378354 - RNA, 18 nt, Human
aggccccagcccacucag

SEQ ID NO: 1378355 - RNA, 23 nt, Human
aggggcaggagggaggcaaagag

SEQ ID NO: 1378356 - RNA, 20 nt, Human
aguaaaaacaaccccaaccc

SEQ ID NO: 1378357 - RNA, 19 nt, Human
aucccacccucaggaccua

SEQ ID NO: 1378358 - RNA, 21 nt, Human
caaacccccaccccuacccag

SEQ ID NO: 1378359 - RNA, 23 nt, Human
caaaucccaagugucaggccccc

SEQ ID NO: 1378360 - RNA, 19 nt, Human
caagacgcccaccagaggc

SEQ ID NO: 1378361 - RNA, 19 nt, Human
caagcccaggggcuuuggg

SEQ ID NO: 1378362 - RNA, 23 nt, Human
caagugucaggcccccggagucc

SEQ ID NO: 1378363 - RNA, 19 nt, Human
caccccacccaggaacagc

SEQ ID NO: 1378364 - RNA, 18 nt, Human
caccucaaggccccagcc

SEQ ID NO: 1378365 - RNA, 22 nt, Human
caccucugccucaaacagccaa

SEQ ID NO: 1378366 - RNA, 22 nt, Human
caccucugccucaaacagccaa

SEQ ID NO: 1378367 - RNA, 25 nt, Human
caccucugccucaaacagccaagcc

SEQ ID NO: 1378368 - RNA, 18 nt, Human
cacugccccucuuuggca

SEQ ID NO: 1378369 - RNA, 22 nt, Human
cacugccccucuuuggcagccc

SEQ ID NO: 1378370 - RNA, 21 nt, Human
cagaaaaaggcaccaaggaca

SEQ ID NO: 1378371 - RNA, 23 nt, Human
cagaaaaaggcaccaaggacagg

SEQ ID NO: 1378372 - RNA, 23 nt, Human
cagaggcuugaccacagggggcg

SEQ ID NO: 1378373 - RNA, 19 nt, Human
cagcagugcccucuucucc

SEQ ID NO: 1378374 - RNA, 19 nt, Human
cagccaccaggaagcccca

SEQ ID NO: 1378375 - RNA, 18 nt, Human
cagccacccccuucccug

SEQ ID NO: 1378376 - RNA, 21 nt, Human
caggggcuuuggggccgcagg

SEQ ID NO: 1378377 - RNA, 20 nt, Human
caugaggauugcuuuuaacc

SEQ ID NO: 1378378 - RNA, 22 nt, Human
ccaaaaguccucagccuucugc

SEQ ID NO: 1378379 - RNA, 23 nt, Human
ccaacccacugccccucuuuggc

SEQ ID NO: 1378380 - RNA, 22 nt, Human
ccacagcagugcccucuucucc

SEQ ID NO: 1378381 - RNA, 19 nt, Human
ccacugccccucuuuggca

SEQ ID NO: 1378382 - RNA, 19 nt, Human
ccagagaaguaaggcaaau

SEQ ID NO: 1378383 - RNA, 23 nt, Human
ccaguagccacaccugugucagg

SEQ ID NO: 1378384 - RNA, 24 nt, Human
cccacaaaugagggcgcucugacc

SEQ ID NO: 1378385 - RNA, 21 nt, Human
cccacaccacagcagugcccu

SEQ ID NO: 1378386 - RNA, 23 nt, Human
cccaccccuacccaggagucuga

SEQ ID NO: 1378387 - RNA, 19 nt, Human
cccagccacccccuucccu

SEQ ID NO: 1378388 - RNA, 23 nt, Human
cccauugccaccccacccaggaa

SEQ ID NO: 1378389 - RNA, 20 nt, Human
ccccaacccacugccccucu

SEQ ID NO: 1378390 - RNA, 23 nt, Human
ccccaacccacugccccucuuug

SEQ ID NO: 1378391 - RNA, 20 nt, Human
ccccaggacugcucccacac

SEQ ID NO: 1378392 - RNA, 21 nt, Human
ccccaggacugcucccacacc

SEQ ID NO: 1378393 - RNA, 18 nt, Human
cccccuccccuugaacca

SEQ ID NO: 1378394 - RNA, 23 nt, Human
ccccggaguccaucaccucugcc

SEQ ID NO: 1378395 - RNA, 22 nt, Human
ccccgugcgggugcggccuccu

SEQ ID NO: 1378396 - RNA, 23 nt, Human
cccuaggggaguggguagccugg

SEQ ID NO: 1378397 - RNA, 19 nt, Human
cccucaggaccuacccagg

SEQ ID NO: 1378398 - RNA, 22 nt, Human
cccucaggaccuacccaggguc

SEQ ID NO: 1378399 - RNA, 21 nt, Human
cccugcccuguggcuuugcgg

SEQ ID NO: 1378400 - RNA, 18 nt, Human
cccugcugccuucaccug

SEQ ID NO: 1378401 - RNA, 21 nt, Human
cccuggccaugaagccccgcc

SEQ ID NO: 1378402 - RNA, 20 nt, Human
ccgcagcgcccagucccgga

SEQ ID NO: 1378403 - RNA, 18 nt, Human
ccgcagguaugaaggccc

SEQ ID NO: 1378404 - RNA, 22 nt, Human
ccgugcgggugcggccucucuu

SEQ ID NO: 1378405 - RNA, 18 nt, Human
ccucaaacagccaagccc

SEQ ID NO: 1378406 - RNA, 23 nt, Human
ccucaaggccccagcccacucag

SEQ ID NO: 1378407 - RNA, 25 nt, Human
ccuccaggcagccaggggccagcuc

SEQ ID NO: 1378408 - RNA, 23 nt, Human
ccuccaguagccacaccuguguc

SEQ ID NO: 1378409 - RNA, 20 nt, Human
ccucccauugccaccccacc

SEQ ID NO: 1378410 - RNA, 23 nt, Human
ccucucuucucggccggcccugg

SEQ ID NO: 1378411 - RNA, 22 nt, Human
ccucugccucaaacagccaagc

SEQ ID NO: 1378412 - RNA, 20 nt, Human
ccuggccaugaagccccgcc

SEQ ID NO: 1378413 - RNA, 19 nt, Human
ccuggcucccggccauggc

SEQ ID NO: 1378414 - RNA, 22 nt, Human
ccuguggcugccuccuggcagg

SEQ ID NO: 1378415 - RNA, 26 nt, Human
ccugugucagggcugugcccuggggc

SEQ ID NO: 1378416 - RNA, 25 nt, Human
ccuucugcagacccagggcagaggc

SEQ ID NO: 1378417 - RNA, 20 nt, Human
cggaacucgaaauucauggg

SEQ ID NO: 1378418 - RNA, 20 nt, Human
cggcaguaacacugcuggca

SEQ ID NO: 1378419 - RNA, 24 nt, Human
cggccgcucgcggggcgcucuggg

SEQ ID NO: 1378420 - RNA, 22 nt, Human
cucaaacccccaccccuaccca

SEQ ID NO: 1378421 - RNA, 26 nt, Human
cucaaacccccaccccuacccaggag

SEQ ID NO: 1378422 - RNA, 24 nt, Human
cucaacucaaacccccaccccuac

SEQ ID NO: 1378423 - RNA, 21 nt, Human
cuccaggacagggcaggagaa

SEQ ID NO: 1378424 - RNA, 24 nt, Human
cucccggccauggccccugcuuug

SEQ ID NO: 1378425 - RNA, 22 nt, Human
cucgccuguggcugccuccugg

SEQ ID NO: 1378426 - RNA, 22 nt, Human
cucgcggggcgcucugggagau

SEQ ID NO: 1378427 - RNA, 19 nt, Human
cucucuucucggccggccc

SEQ ID NO: 1378428 - RNA, 21 nt, Human
cucuucuccaucccacccuca

SEQ ID NO: 1378429 - RNA, 22 nt, Human
cugggguagacccagggucucc

SEQ ID NO: 1378430 - RNA, 24 nt, Human
cuuaggccugagcgaggcccuggc

SEQ ID NO: 1378431 - RNA, 18 nt, Human
cuucucggccggcccugg

SEQ ID NO: 1378432 - RNA, 20 nt, Human
gaccucggccuucccuggac

SEQ ID NO: 1378433 - RNA, 21 nt, Human
gaccuguccucccauugccac

SEQ ID NO: 1378434 - RNA, 24 nt, Human
gaccuguccucccauugccacccc

SEQ ID NO: 1378435 - RNA, 22 nt, Human
gagaaacccggaggggcagccc

SEQ ID NO: 1378436 - RNA, 23 nt, Human
gagcacagguggggaaacuuagg

SEQ ID NO: 1378437 - RNA, 18 nt, Human
gauugcuuuuaaccaaaa

SEQ ID NO: 1378438 - RNA, 19 nt, Human
gcacacauccaggaugcag

SEQ ID NO: 1378439 - RNA, 23 nt, Human
gcacucgccuguggcugccuccu

SEQ ID NO: 1378440 - RNA, 21 nt, Human
gcaggagggaggcaaagagga

SEQ ID NO: 1378441 - RNA, 23 nt, Human
gccagccaggaggcccagccacc

SEQ ID NO: 1378442 - RNA, 21 nt, Human
gccccaggacugcucccacac

SEQ ID NO: 1378443 - RNA, 21 nt, Human
gcccuccacuccggaaacgga

SEQ ID NO: 1378444 - RNA, 19 nt, Human
gcccucuucuccaucccac

SEQ ID NO: 1378445 - RNA, 20 nt, Human
gcccucuucuccaucccacc

SEQ ID NO: 1378446 - RNA, 23 nt, Human
gcgaggcccuggccaugaagccc

SEQ ID NO: 1378447 - RNA, 26 nt, Human
gcuacaaucgguuugucuuuauaaaa

SEQ ID NO: 1378448 - RNA, 19 nt, Human
gcucugggagaugcagucc

SEQ ID NO: 1378449 - RNA, 20 nt, Human
ggaagccucccaaaucccaa

SEQ ID NO: 1378450 - RNA, 19 nt, Human
ggaguccaucaccucugcc

SEQ ID NO: 1378451 - RNA, 23 nt, Human
ggcaccaaggacaggaugagaaa

SEQ ID NO: 1378452 - RNA, 20 nt, Human
ggccaugaagccccgcccag

SEQ ID NO: 1378453 - RNA, 19 nt, Human
ggcgacugcgagcccgggg

SEQ ID NO: 1378454 - RNA, 24 nt, Human
gggcagaaaaaggcaccaaggaca

SEQ ID NO: 1378455 - RNA, 26 nt, Human
gggcaggagaaugcgguccaggucug

SEQ ID NO: 1378456 - RNA, 22 nt, Human
gggcagggcacgcggcuggcca

SEQ ID NO: 1378457 - RNA, 23 nt, Human
gggcugugcccuggggccuggcc

SEQ ID NO: 1378458 - RNA, 21 nt, Human
guaaaaacaaccccaacccac

SEQ ID NO: 1378459 - RNA, 22 nt, Human
guaugaaggccccuccaguagc

SEQ ID NO: 1378460 - RNA, 21 nt, Human
guccaucaccucugccucaaa

SEQ ID NO: 1378461 - RNA, 22 nt, Human
guggcuuugcggggagacacag

SEQ ID NO: 1378462 - RNA, 22 nt, Human
uaaaaacaaccccaacccacug

SEQ ID NO: 1378463 - RNA, 27 nt, Human
uaaggcaaauggcccagaugacgacca

SEQ ID NO: 1378464 - RNA, 23 nt, Human
uaaguagagcccuuugccagcca

SEQ ID NO: 1378465 - RNA, 21 nt, Human
uaggaagccucccaaauccca

SEQ ID NO: 1378466 - RNA, 20 nt, Human
uaggggaguggguagccugg

SEQ ID NO: 1378467 - RNA, 22 nt, Human
ucaaacagccaagcccaggggc

SEQ ID NO: 1378468 - RNA, 18 nt, Human
ucaaagcuaggccuggcu

SEQ ID NO: 1378469 - RNA, 21 nt, Human
ucaacucaaacccccaccccu

SEQ ID NO: 1378470 - RNA, 23 nt, Human
ucacagccaccaggaagccccag

SEQ ID NO: 1378471 - RNA, 23 nt, Human
ucagccuucugcagacccagggc

SEQ ID NO: 1378472 - RNA, 19 nt, Human
uccacuccggaaacggaac

SEQ ID NO: 1378473 - RNA, 19 nt, Human
uccagagaaguaaggcaaa

SEQ ID NO: 1378474 - RNA, 23 nt, Human
uccaucaccucugccucaaacaa

SEQ ID NO: 1378475 - RNA, 24 nt, Human
ucccaaaucccaagugucaggccc

SEQ ID NO: 1378476 - RNA, 18 nt, Human
ucugcagacccagggcag

SEQ ID NO: 1378477 - RNA, 19 nt, Human
ucugcagacccagggcaga

SEQ ID NO: 1378478 - RNA, 22 nt, Human
ucugcagacccagggcagaggc

SEQ ID NO: 1378479 - RNA, 24 nt, Human
ugagccugggagacccuaggggag

SEQ ID NO: 1378480 - RNA, 21 nt, Human
ugcaggugaggcaccacaugg

SEQ ID NO: 1378481 - RNA, 24 nt, Human
ugccaccccacccaggaacagccc

SEQ ID NO: 1378482 - RNA, 25 nt, Human
ugcccuccacuccggaaacggaacc

SEQ ID NO: 1378483 - RNA, 19 nt, Human
uggcacucgccuguggcug

SEQ ID NO: 1378484 - RNA, 18 nt, Human
uggcagcccuugaaacuc

SEQ ID NO: 1378485 - RNA, 21 nt, Human
uggcccagaugacgaccaccu

SEQ ID NO: 1378486 - RNA, 21 nt, Human
uggcucccggccauggccccu

SEQ ID NO: 1378487 - RNA, 19 nt, Human
uggcugccaagcagggugg

SEQ ID NO: 1378488 - RNA, 21 nt, Human
ugggcuuguguucuggauguc

SEQ ID NO: 1378489 - RNA, 19 nt, Human
uggggcagggcacgcggcu

SEQ ID NO: 1378490 - RNA, 22 nt, Human
uggggccgcagguaugaaggcc

SEQ ID NO: 1378491 - RNA, 20 nt, Human
ugugucugugugugcaggau

SEQ ID NO: 1378492 - RNA, 21 nt, Human
uugaaccaucaggaacugggc

SEQ ID NO: 1378493 - RNA, 23 nt, Human
uuggggccgcagguaugaaggcc

SEQ ID NO: 1378494 - RNA, 24 nt, Human
uuuaaccaaaaguccucagccuuc

SEQ ID NO: 1378495 - RNA, 20 nt, Human
uuuuuuuuuuuuucacuuca

SEQ ID NO: 1378496 - RNA, 21 nt, Human
uuuuuuuuuuuuucacuucag

SEQ ID NO: 1378497 - RNA, 22 nt, Human
uuuuuuuuuuuuuuuuucacuu

SEQ ID NO: 1378498 - RNA, 20 nt, Human
gggcgguggggggcuggggc

SEQ ID NO: 1378499 - RNA, 23 nt, Human
gggggcgguggggggcuggggcg

SEQ ID NO: 1378500 - RNA, 24 nt, Human
ucuuuguagagagcgcagagcuug

SEQ ID NO: 1378501 - RNA, 21 nt, Human
ugggggcgguggggggcuggg

SEQ ID NO: 1378502 - RNA, 22 nt, Human
uggggggcuggggcgucugcgc

SEQ ID NO: 1378503 - RNA, 18 nt, Human
aagauggauucuuggugg

SEQ ID NO: 1378504 - RNA, 21 nt, Human
aagccuuggagcagugaagug

SEQ ID NO: 1378505 - RNA, 26 nt, Human
aagugucucuccaggauuuucuuucc

SEQ ID NO: 1378506 - RNA, 24 nt, Human
acaacgaaacuaacacagcauaag

SEQ ID NO: 1378507 - RNA, 23 nt, Human
agaggucugagggaagggaggca

SEQ ID NO: 1378508 - RNA, 19 nt, Human
agcagugaagugucucucc

SEQ ID NO: 1378509 - RNA, 18 nt, Human
aggaagggccucugggug

SEQ ID NO: 1378510 - RNA, 22 nt, Human
caaacccugggcuuggaauuca

SEQ ID NO: 1378511 - RNA, 18 nt, Human
cagggcccaagccagaag

SEQ ID NO: 1378512 - RNA, 23 nt, Human
ccaagccagaagagggauaagga

SEQ ID NO: 1378513 - RNA, 18 nt, Human
cccucaggaagggccucu

SEQ ID NO: 1378514 - RNA, 18 nt, Human
ccucuggguggccucugc

SEQ ID NO: 1378515 - RNA, 23 nt, Human
cucaggaagggccucuggguggg

SEQ ID NO: 1378516 - RNA, 20 nt, Human
cucccagggccagagcagca

SEQ ID NO: 1378517 - RNA, 21 nt, Human
cuggaguuagcaagcagcccc

SEQ ID NO: 1378518 - RNA, 20 nt, Human
gaaagacuuaggugucaggg

SEQ ID NO: 1378519 - RNA, 18 nt, Human
gaagagguggcgguccuc

SEQ ID NO: 1378520 - RNA, 18 nt, Human
gaauguggccggcccuca

SEQ ID NO: 1378521 - RNA, 19 nt, Human
ggcuuggaauucagcuccc

SEQ ID NO: 1378522 - RNA, 18 nt, Human
gggaauguggccggcccu

SEQ ID NO: 1378523 - RNA, 21 nt, Human
gggcccaagccagaagaggga

SEQ ID NO: 1378524 - RNA, 21 nt, Human
gucucuccaggauuuucuuuc

SEQ ID NO: 1378525 - RNA, 20 nt, Human
guggccucugcaucccuggc

SEQ ID NO: 1378526 - RNA, 20 nt, Human
uaaaccgugggaaagacuua

SEQ ID NO: 1378527 - RNA, 18 nt, Human
uaagcccucaagcuaggc

SEQ ID NO: 1378528 - RNA, 24 nt, Human
uaagcccucaagcuaggcaagaca

SEQ ID NO: 1378529 - RNA, 19 nt, Human
uaaggacuuaagcccucaa

SEQ ID NO: 1378530 - RNA, 22 nt, Human
ucagggcccaagccagaagagg

SEQ ID NO: 1378531 - RNA, 22 nt, Human
ucccagggccagagcagcaucu

SEQ ID NO: 1378532 - RNA, 24 nt, Human
uccuggaagaauguccuuucuacc

SEQ ID NO: 1378533 - RNA, 21 nt, Human
ucgcaagcacugggaagaggu

SEQ ID NO: 1378534 - RNA, 21 nt, Human
ucuacccaaucugcccaggag

SEQ ID NO: 1378535 - RNA, 25 nt, Human
ugagggaagggaggcaggcagcuua

SEQ ID NO: 1378536 - RNA, 23 nt, Human
ugagggagaggucugagggaagg

SEQ ID NO: 1378537 - RNA, 21 nt, Human
ugcccaggagggcgggaaugu

SEQ ID NO: 1378538 - RNA, 20 nt, Human
ugggcuuggaauucagcucc

SEQ ID NO: 1378539 - RNA, 18 nt, Human
ugucagggcccaagccag

SEQ ID NO: 1378540 - RNA, 23 nt, Human
ugucucaaaagccuuggagcagu

SEQ ID NO: 1378541 - RNA, 19 nt, Human
uuaaaaagacagaaaugcc

SEQ ID NO: 1378542 - RNA, 18 nt, Human
uucugacaacgaaacuaa

SEQ ID NO: 1378543 - RNA, 22 nt, Human
uuggaauucagcucccagggcc

SEQ ID NO: 1378544 - RNA, 21 nt, Human
aagauuccacuccacaagaua

SEQ ID NO: 1378545 - RNA, 21 nt, Human
aaucacuugcacccaaggcuu

SEQ ID NO: 1378546 - RNA, 19 nt, Human
agaguagaagcagacucac

SEQ ID NO: 1378547 - RNA, 19 nt, Human
agcuccucagcggcagccu

SEQ ID NO: 1378548 - RNA, 19 nt, Human
auggggcugccuuuugcca

SEQ ID NO: 1378549 - RNA, 21 nt, Human
caaaacucugucccuuacugu

SEQ ID NO: 1378550 - RNA, 24 nt, Human
caaaaguaacccucaaauguucga

SEQ ID NO: 1378551 - RNA, 22 nt, Human
cacuucucauccugugcuacug

SEQ ID NO: 1378552 - RNA, 19 nt, Human
cagcggcagccuguugcgc

SEQ ID NO: 1378553 - RNA, 21 nt, Human
caugaggaagauuccacucca

SEQ ID NO: 1378554 - RNA, 19 nt, Human
ccaaaaguaacccucaaau

SEQ ID NO: 1378555 - RNA, 19 nt, Human
ccccaccagcuccagcucc

SEQ ID NO: 1378556 - RNA, 21 nt, Human
ccccaccagcuccagcuccuc

SEQ ID NO: 1378557 - RNA, 21 nt, Human
ccugugcuacugacauucagg

SEQ ID NO: 1378558 - RNA, 18 nt, Human
cucacuccauggccaggc

SEQ ID NO: 1378559 - RNA, 20 nt, Human
cucacucuaugcaggaccac

SEQ ID NO: 1378560 - RNA, 23 nt, Human
cuguugcugaauagguuuguauu

SEQ ID NO: 1378561 - RNA, 18 nt, Human
gaaucacuugcacccaag

SEQ ID NO: 1378562 - RNA, 21 nt, Human
gcuccucagcggcagccuguu

SEQ ID NO: 1378563 - RNA, 18 nt, Human
ggacaaguggaccccaaa

SEQ ID NO: 1378564 - RNA, 23 nt, Human
ggacaaguggaccccaaaacucu

SEQ ID NO: 1378565 - RNA, 19 nt, Human
guaagacagagguuucgaa

SEQ ID NO: 1378566 - RNA, 33 nt, Human
gucccuuacuguugcucccgugaucucugauua

SEQ ID NO: 1378567 - RNA, 20 nt, Human
ucacuccauggccaggcucu

SEQ ID NO: 1378568 - RNA, 25 nt, Human
ucagaaacagcauauaccaccaaaa

SEQ ID NO: 1378569 - RNA, 22 nt, Human
ucagaacaccaagaaugcuuag

SEQ ID NO: 1378570 - RNA, 20 nt, Human
uccacaagauacagaaccca

SEQ ID NO: 1378571 - RNA, 21 nt, Human
uccacaagauacagaacccac

SEQ ID NO: 1378572 - RNA, 18 nt, Human
ucuaaagcagagucacuu

SEQ ID NO: 1378573 - RNA, 21 nt, Human
ugcaagauaaaaggcacaugu

SEQ ID NO: 1378574 - RNA, 19 nt, Human
ugcggcccaguccccacca

SEQ ID NO: 1378575 - RNA, 19 nt, Human
ugugcuguugcugaauagg

SEQ ID NO: 1378576 - RNA, 21 nt, Human
uucagaaacagcauauaccac

SEQ ID NO: 1378577 - RNA, 24 nt, Human
uuugccaccugggaaucacuugca

SEQ ID NO: 1378578 - RNA, 21 nt, Human
aaacacccaggagcccacccu

SEQ ID NO: 1378579 - RNA, 23 nt, Human
aaacacccaggagcccacccuuc

SEQ ID NO: 1378580 - RNA, 19 nt, Human
aaacacucagccccgaaga

SEQ ID NO: 1378581 - RNA, 21 nt, Human
aagcaaacacccaggagccca

SEQ ID NO: 1378582 - RNA, 28 nt, Human
aagcaaacacccaggagcccacccuuca

SEQ ID NO: 1378583 - RNA, 20 nt, Human
aagcagaaggaauccccccc

SEQ ID NO: 1378584 - RNA, 19 nt, Human
aaugcagacaccauucacc

SEQ ID NO: 1378585 - RNA, 22 nt, Human
acaacagcacagauccggcccg

SEQ ID NO: 1378586 - RNA, 20 nt, Human
acacaguccagccuccaucc

SEQ ID NO: 1378587 - RNA, 21 nt, Human
acacugcaacccacuuuggug

SEQ ID NO: 1378588 - RNA, 24 nt, Human
accgcaacuucuccugccuggcug

SEQ ID NO: 1378589 - RNA, 24 nt, Human
accguggagccccuggacagccuc

SEQ ID NO: 1378590 - RNA, 23 nt, Human
acucucccucuucccugaaguuc

SEQ ID NO: 1378591 - RNA, 23 nt, Human
agaggagacagacccaaacuuuu

SEQ ID NO: 1378592 - RNA, 23 nt, Human
agccccuggacagccucacccuc

SEQ ID NO: 1378593 - RNA, 21 nt, Human
agccuccaaggcaggucaucc

SEQ ID NO: 1378594 - RNA, 18 nt, Human
agcugguagccugagccc

SEQ ID NO: 1378595 - RNA, 22 nt, Human
aggaagcaguggggcagaggcg

SEQ ID NO: 1378596 - RNA, 23 nt, Human
aggaagcaguggggcagaggcgg

SEQ ID NO: 1378597 - RNA, 21 nt, Human
aggagaagagggccuggcuga

SEQ ID NO: 1378598 - RNA, 18 nt, Human
aggcaggaagcagugggg

SEQ ID NO: 1378599 - RNA, 23 nt, Human
aggcaggaagcaguggggcagag

SEQ ID NO: 1378600 - RNA, 18 nt, Human
aggcugcugggacugcac

SEQ ID NO: 1378601 - RNA, 21 nt, Human
agggaggggagccaccauggg

SEQ ID NO: 1378602 - RNA, 21 nt, Human
agugucuccuccugggauaac

SEQ ID NO: 1378603 - RNA, 18 nt, Human
augucuguaaaacuacca

SEQ ID NO: 1378604 - RNA, 28 nt, Human
auugcuacugagggagggugggggaaac

SEQ ID NO: 1378605 - RNA, 24 nt, Human
auuuuaaugcagacaccauucacc

SEQ ID NO: 1378606 - RNA, 23 nt, Human
caacagcacagauccggcccguc

SEQ ID NO: 1378607 - RNA, 19 nt, Human
caacagcacggcugacaga

SEQ ID NO: 1378608 - RNA, 24 nt, Human
caacagcacggcugacagagagga

SEQ ID NO: 1378609 - RNA, 20 nt, Human
caacaggcccccaucuggcc

SEQ ID NO: 1378610 - RNA, 18 nt, Human
caacccacuuugguggcu

SEQ ID NO: 1378611 - RNA, 23 nt, Human
caaguccccagcuuggaccucaa

SEQ ID NO: 1378612 - RNA, 18 nt, Human
cacaguccagccuccauc

SEQ ID NO: 1378613 - RNA, 24 nt, Human
cacaguccagccuccauccucaac

SEQ ID NO: 1378614 - RNA, 24 nt, Human
cacccaggagcccacccuucaucc

SEQ ID NO: 1378615 - RNA, 18 nt, Human
cacccuucauccugaggc

SEQ ID NO: 1378616 - RNA, 18 nt, Human
caccgcaacuucuccugc

SEQ ID NO: 1378617 - RNA, 22 nt, Human
cacucugggccccuccagccac

SEQ ID NO: 1378618 - RNA, 20 nt, Human
cagccccgaagauguuggag

SEQ ID NO: 1378619 - RNA, 21 nt, Human
caggagauggcccuggccagg

SEQ ID NO: 1378620 - RNA, 20 nt, Human
caguggggcagaggcgggcu

SEQ ID NO: 1378621 - RNA, 19 nt, Human
cauagcaaccaugaguggc

SEQ ID NO: 1378622 - RNA, 19 nt, Human
caugucuguaaaacuacca

SEQ ID NO: 1378623 - RNA, 23 nt, Human
ccauucaccacucaucucugcaa

SEQ ID NO: 1378624 - RNA, 19 nt, Human
cccaccguggagccccugg

SEQ ID NO: 1378625 - RNA, 19 nt, Human
ccccucccuccccagagcc

SEQ ID NO: 1378626 - RNA, 19 nt, Human
ccccugcagagccuccaag

SEQ ID NO: 1378627 - RNA, 19 nt, Human
ccccuggacagccucaccc

SEQ ID NO: 1378628 - RNA, 19 nt, Human
cccgaguagcucauugcua

SEQ ID NO: 1378629 - RNA, 22 nt, Human
cccuccccacccucuccuucac

SEQ ID NO: 1378630 - RNA, 23 nt, Human
cccuccccacccucuccuucaca

SEQ ID NO: 1378631 - RNA, 24 nt, Human
cccuccccacccucuccuucacag

SEQ ID NO: 1378632 - RNA, 23 nt, Human
cccugugcccacagugucuccuc

SEQ ID NO: 1378633 - RNA, 18 nt, Human
ccggccaggccaccuccu

SEQ ID NO: 1378634 - RNA, 19 nt, Human
ccuccuccccaaccgugga

SEQ ID NO: 1378635 - RNA, 18 nt, Human
ccugacacugcaacccac

SEQ ID NO: 1378636 - RNA, 21 nt, Human
ccugcagagccuccaaggcag

SEQ ID NO: 1378637 - RNA, 26 nt, Human
ccuggacuuagcccugugccgguucc

SEQ ID NO: 1378638 - RNA, 21 nt, Human
ccuggccacagcaggacaaag

SEQ ID NO: 1378639 - RNA, 26 nt, Human
ccuggccccaggagaccucaggccac

SEQ ID NO: 1378640 - RNA, 18 nt, Human
ccuugcccccucccuccc

SEQ ID NO: 1378641 - RNA, 19 nt, Human
cgaagauguuggagaucua

SEQ ID NO: 1378642 - RNA, 26 nt, Human
cgaauacaaacaccuggacuuagccc

SEQ ID NO: 1378643 - RNA, 18 nt, Human
cgacaagagaggugcagg

SEQ ID NO: 1378644 - RNA, 18 nt, Human
cgccagcagcggaugggc

SEQ ID NO: 1378645 - RNA, 20 nt, Human
cggccaggccaccuccuccc

SEQ ID NO: 1378646 - RNA, 23 nt, Human
cggccaggccaccuccuccccaa

SEQ ID NO: 1378647 - RNA, 19 nt, Human
cggcuuggaggaggcugcc

SEQ ID NO: 1378648 - RNA, 24 nt, Human
cgggaaggcagccccugcuccggu

SEQ ID NO: 1378649 - RNA, 21 nt, Human
cuaccacacaguccagccucc

SEQ ID NO: 1378650 - RNA, 19 nt, Human
cucagcucugcccaagaag

SEQ ID NO: 1378651 - RNA, 19 nt, Human
cucauugcuacugagggag

SEQ ID NO: 1378652 - RNA, 23 nt, Human
cuccccgaccacucugggccccc

SEQ ID NO: 1378653 - RNA, 22 nt, Human
cucccuagaugccucccucccc

SEQ ID NO: 1378654 - RNA, 26 nt, Human
cucccucuucccugaaguucuuucca

SEQ ID NO: 1378655 - RNA, 23 nt, Human
cuccuuuguccccugcagagccu

SEQ ID NO: 1378656 - RNA, 21 nt, Human
cucggccaccaucaagcccca

SEQ ID NO: 1378657 - RNA, 19 nt, Human
cucugcacuggagccggcc

SEQ ID NO: 1378658 - RNA, 19 nt, Human
cugaaggacugugacaggc

SEQ ID NO: 1378659 - RNA, 18 nt, Human
cugacacugcaacccacu

SEQ ID NO: 1378660 - RNA, 22 nt, Human
cugcacccccauccugaccaga

SEQ ID NO: 1378661 - RNA, 18 nt, Human
cugcccccacugaggucc

SEQ ID NO: 1378662 - RNA, 19 nt, Human
cugcccccacugagguccc

SEQ ID NO: 1378663 - RNA, 21 nt, Human
cuggacuuagcccugugccca

SEQ ID NO: 1378664 - RNA, 19 nt, Human
cuggccacagcaggacaaa

SEQ ID NO: 1378665 - RNA, 19 nt, Human
cuggccuuggcuccccucc

SEQ ID NO: 1378666 - RNA, 20 nt, Human
cugggaugaggggugggggg

SEQ ID NO: 1378667 - RNA, 22 nt, Human
cugggggucuggguugggggug

SEQ ID NO: 1378668 - RNA, 23 nt, Human
cugggggucuggguugggggugg

SEQ ID NO: 1378669 - RNA, 20 nt, Human
cuguccugcucugcuucauc

SEQ ID NO: 1378670 - RNA, 19 nt, Human
cugugcccacagugucucc

SEQ ID NO: 1378671 - RNA, 25 nt, Human
cuugacggcucucccuggccuuggc

SEQ ID NO: 1378672 - RNA, 23 nt, Human
cuuguagacaccuggucaccgga

SEQ ID NO: 1378673 - RNA, 21 nt, Human
cuuugguggcugugggcaagu

SEQ ID NO: 1378674 - RNA, 19 nt, Human
gaaacacacccuggcccag

SEQ ID NO: 1378675 - RNA, 21 nt, Human
gaaguucacucagcucugccc

SEQ ID NO: 1378676 - RNA, 22 nt, Human
gacaccauucaccacucaucuc

SEQ ID NO: 1378677 - RNA, 24 nt, Human
gacaggagauggcccuggccaggg

SEQ ID NO: 1378678 - RNA, 22 nt, Human
gacucugcucaggggcgcugcc

SEQ ID NO: 1378679 - RNA, 23 nt, Human
gagcgggcggcggggucuggggg

SEQ ID NO: 1378680 - RNA, 23 nt, Human
gaggaggcugccccaggccuucc

SEQ ID NO: 1378681 - RNA, 20 nt, Human
gagguccagcccuggcugaa

SEQ ID NO: 1378682 - RNA, 20 nt, Human
gauggcccuggccaggggga

SEQ ID NO: 1378683 - RNA, 22 nt, Human
gcaacaucuuucacaaacacuc

SEQ ID NO: 1378684 - RNA, 21 nt, Human
gcacuggagccggccaggcca

SEQ ID NO: 1378685 - RNA, 19 nt, Human
gcaggaggcggcuccgggg

SEQ ID NO: 1378686 - RNA, 19 nt, Human
gccaccgcaacuucuccug

SEQ ID NO: 1378687 - RNA, 20 nt, Human
gccaggccaccuccucccca

SEQ ID NO: 1378688 - RNA, 22 nt, Human
gccagggaggggagccaccaug

SEQ ID NO: 1378689 - RNA, 19 nt, Human
gcccgaauacaaacaccug

SEQ ID NO: 1378690 - RNA, 18 nt, Human
gccucccuccccacccuc

SEQ ID NO: 1378691 - RNA, 19 nt, Human
gccuggcugagguugaggg

SEQ ID NO: 1378692 - RNA, 18 nt, Human
gcgggcggcggggucugg

SEQ ID NO: 1378693 - RNA, 23 nt, Human
gcucugcuucaucuucggccagc

SEQ ID NO: 1378694 - RNA, 20 nt, Human
gcugaaggacugugacaggc

SEQ ID NO: 1378695 - RNA, 21 nt, Human
gcugcugggacugcaccccca

SEQ ID NO: 1378696 - RNA, 23 nt, Human
ggcaccggggagucgacaagaga

SEQ ID NO: 1378697 - RNA, 20 nt, Human
ggcucucccuggccuuggcu

SEQ ID NO: 1378698 - RNA, 25 nt, Human
gggcagaggcgggcugacguggcuu

SEQ ID NO: 1378699 - RNA, 18 nt, Human
gggccccuccagccaccu

SEQ ID NO: 1378700 - RNA, 22 nt, Human
ggucugggggucuggguugggg

SEQ ID NO: 1378701 - RNA, 20 nt, Human
ggucuggguuggggguggac

SEQ ID NO: 1378702 - RNA, 22 nt, Human
ggugcaggaggcggcuccgggg

SEQ ID NO: 1378703 - RNA, 27 nt, Human
gugcccaccguggagccccuggacagc

SEQ ID NO: 1378704 - RNA, 23 nt, Human
uaagacccuugcccccucccucc

SEQ ID NO: 1378705 - RNA, 19 nt, Human
uagcccgaauacaaacacc

SEQ ID NO: 1378706 - RNA, 22 nt, Human
uagcccgaauacaaacaccugg

SEQ ID NO: 1378707 - RNA, 26 nt, Human
ucacgguggugucgguguugcugucc

SEQ ID NO: 1378708 - RNA, 25 nt, Human
uccaaguccccagcuuggaccucaa

SEQ ID NO: 1378709 - RNA, 21 nt, Human
uccacaaugagaaguuuggcc

SEQ ID NO: 1378710 - RNA, 21 nt, Human
uccaggccacgguguccagca

SEQ ID NO: 1378711 - RNA, 23 nt, Human
ucccagcccaugcaacaggcccc

SEQ ID NO: 1378712 - RNA, 19 nt, Human
ucccauggcugcugacaag

SEQ ID NO: 1378713 - RNA, 19 nt, Human
uccccagagccugugucgg

SEQ ID NO: 1378714 - RNA, 19 nt, Human
uccccagagcucugcugcu

SEQ ID NO: 1378715 - RNA, 22 nt, Human
ucccccccuccccucuugcucc

SEQ ID NO: 1378716 - RNA, 19 nt, Human
ucccccugcuccaggcagg

SEQ ID NO: 1378717 - RNA, 21 nt, Human
uccccgaccacucugggcccc

SEQ ID NO: 1378718 - RNA, 24 nt, Human
ucccuagaugccucccuccccacc

SEQ ID NO: 1378719 - RNA, 22 nt, Human
ucccugaaguucuuuccaaguc

SEQ ID NO: 1378720 - RNA, 22 nt, Human
uccucggccaccaucaagcccc

SEQ ID NO: 1378721 - RNA, 20 nt, Human
uccuuuguccccugcagagc

SEQ ID NO: 1378722 - RNA, 19 nt, Human
ucgacaagagaggugcagg

SEQ ID NO: 1378723 - RNA, 23 nt, Human
ucuugcuccauuacuaggcugga

SEQ ID NO: 1378724 - RNA, 23 nt, Human
ucuuucacaaacacucagccccg

SEQ ID NO: 1378725 - RNA, 20 nt, Human
ugaccuugacggcucucccu

SEQ ID NO: 1378726 - RNA, 19 nt, Human
ugacggcucucccuggccu

SEQ ID NO: 1378727 - RNA, 24 nt, Human
ugagggagagagggugggggcucu

SEQ ID NO: 1378728 - RNA, 23 nt, Human
ugaggggggauccguggauggag

SEQ ID NO: 1378729 - RNA, 21 nt, Human
ugagggguggggggcccagcg

SEQ ID NO: 1378730 - RNA, 21 nt, Human
ugagugcagggugcccaccgu

SEQ ID NO: 1378731 - RNA, 22 nt, Human
ugcccccucccuccccagagcc

SEQ ID NO: 1378732 - RNA, 26 nt, Human
ugccucccuccccacccucuccuuca

SEQ ID NO: 1378733 - RNA, 21 nt, Human
ugcucugcuucaucuucggcc

SEQ ID NO: 1378734 - RNA, 19 nt, Human
uggaacaccauggugacag

SEQ ID NO: 1378735 - RNA, 19 nt, Human
uggaccucaacugcuccag

SEQ ID NO: 1378736 - RNA, 27 nt, Human
uggcaacaucuuucacaaacacucagc

SEQ ID NO: 1378737 - RNA, 22 nt, Human
uggcaugaaguucacucagcuc

SEQ ID NO: 1378738 - RNA, 23 nt, Human
uggcaugaaguucacucagcucu

SEQ ID NO: 1378739 - RNA, 20 nt, Human
uggccaccgcaacuucuccu

SEQ ID NO: 1378740 - RNA, 18 nt, Human
uggccagggggaggcugc

SEQ ID NO: 1378741 - RNA, 22 nt, Human
uggcugaaggacugugacaggc

SEQ ID NO: 1378742 - RNA, 24 nt, Human
uggcugugggcaaguccuucacca

SEQ ID NO: 1378743 - RNA, 27 nt, Human
ugggaagcaaacacccaggagcccagu

SEQ ID NO: 1378744 - RNA, 18 nt, Human
ugggaugagggguggggg

SEQ ID NO: 1378745 - RNA, 18 nt, Human
uggggugacugcuggaug

SEQ ID NO: 1378746 - RNA, 21 nt, Human
ugguaacugggaucacaggac

SEQ ID NO: 1378747 - RNA, 25 nt, Human
ugguagccugagcccugggccaccu

SEQ ID NO: 1378748 - RNA, 18 nt, Human
uggugaggggggauccgu

SEQ ID NO: 1378749 - RNA, 21 nt, Human
uggugucgguguugcuguccc

SEQ ID NO: 1378750 - RNA, 23 nt, Human
uucauuucugaaggagaggagac

SEQ ID NO: 1378751 - RNA, 22 nt, Human
uuccccaggagaagagggccug

SEQ ID NO: 1378752 - RNA, 20 nt, Human
uucgugacaucuguccugcu

SEQ ID NO: 1378753 - RNA, 24 nt, Human
uuggagaucuauggugagggggga

SEQ ID NO: 1378754 - RNA, 25 nt, Human
uuggcugggaccaugccacccucca

SEQ ID NO: 1378755 - RNA, 18 nt, Human
uuuguccccugcagagcc

SEQ ID NO: 1378756 - RNA, 21 nt, Human
uuuguccccugcagagccucc

SEQ ID NO: 1378757 - RNA, 22 nt, Human
aaaaaaaaaaaguccucaaagg

SEQ ID NO: 1378758 - RNA, 23 nt, Human
aaaucaaggugaaacauaccccu

SEQ ID NO: 1378759 - RNA, 20 nt, Human
aacacugaaagaaccgggcc

SEQ ID NO: 1378760 - RNA, 18 nt, Human
aagaaccgggccaaaauc

SEQ ID NO: 1378761 - RNA, 25 nt, Human
aaucagcauuguuuuaaagagguuu

SEQ ID NO: 1378762 - RNA, 22 nt, Human
acacugaaagaaccgggccaaa

SEQ ID NO: 1378763 - RNA, 19 nt, Human
acccauuuaaaaacaggau

SEQ ID NO: 1378764 - RNA, 19 nt, Human
acggaacacugaaagaacc

SEQ ID NO: 1378765 - RNA, 18 nt, Human
agagguuuuuauuggagg

SEQ ID NO: 1378766 - RNA, 22 nt, Human
agauaauacccucaaacaaacc

SEQ ID NO: 1378767 - RNA, 19 nt, Human
auacccucaaacaaaccca

SEQ ID NO: 1378768 - RNA, 23 nt, Human
auuccuguuuuucucuuguucac

SEQ ID NO: 1378769 - RNA, 24 nt, Human
caaacaaacccauuuaaaaacagg

SEQ ID NO: 1378770 - RNA, 22 nt, Human
caaaccuauuaauuuacuaaaa

SEQ ID NO: 1378771 - RNA, 22 nt, Human
caaacuaauaagaaaaucagca

SEQ ID NO: 1378772 - RNA, 19 nt, Human
caaggugaaacauaccccu

SEQ ID NO: 1378773 - RNA, 21 nt, Human
cacugaaagaaccgggccaaa

SEQ ID NO: 1378774 - RNA, 20 nt, Human
cccaggagaagugaaaugag

SEQ ID NO: 1378775 - RNA, 19 nt, Human
cucaauaccauauuagcuc

SEQ ID NO: 1378776 - RNA, 23 nt, Human
cuuuuuggaauuucugauaaaua

SEQ ID NO: 1378777 - RNA, 24 nt, Human
gaacacugaaagaaccgggccaaa

SEQ ID NO: 1378778 - RNA, 19 nt, Human
guaaaauguuauacuuuca

SEQ ID NO: 1378779 - RNA, 20 nt, Human
guucuucacauaaauuccag

SEQ ID NO: 1378780 - RNA, 19 nt, Human
uaaaaacacuccaaccaug

SEQ ID NO: 1378781 - RNA, 19 nt, Human
uaaaaaggguaaacggaac

SEQ ID NO: 1378782 - RNA, 22 nt, Human
uaaacggaacacugaaagaacc

SEQ ID NO: 1378783 - RNA, 24 nt, Human
uaccagaagauaauacccucaaac

SEQ ID NO: 1378784 - RNA, 19 nt, Human
uacccucaaacaaacccau

SEQ ID NO: 1378785 - RNA, 23 nt, Human
uacccucaaacaaacccauuuaa

SEQ ID NO: 1378786 - RNA, 19 nt, Human
uagcucaaaagaauaccag

SEQ ID NO: 1378787 - RNA, 21 nt, Human
uauugaguaucauuuuccauu

SEQ ID NO: 1378788 - RNA, 22 nt, Human
uauuuauuuacacauuuacaua

SEQ ID NO: 1378789 - RNA, 23 nt, Human
ucccaggagaagugaaaugaguu

SEQ ID NO: 1378790 - RNA, 21 nt, Human
uccuguuuuucucuuguucac

SEQ ID NO: 1378791 - RNA, 19 nt, Human
ucuauagaaaugcuucugu

SEQ ID NO: 1378792 - RNA, 20 nt, Human
ucuauagaaaugcuucuguu

SEQ ID NO: 1378793 - RNA, 22 nt, Human
ucugaucuaaaaacacuccaac

SEQ ID NO: 1378794 - RNA, 24 nt, Human
ugaauucaaaaaucagcauuguuu

SEQ ID NO: 1378795 - RNA, 23 nt, Human
ugaucuaaaaacacuccaaccau

SEQ ID NO: 1378796 - RNA, 21 nt, Human
uguguuuauauauaagugugu

SEQ ID NO: 1378797 - RNA, 23 nt, Human
uucaaauaacaaaacgcagguug

SEQ ID NO: 1378798 - RNA, 22 nt, Human
uuuucagucucacuuuagaaau

SEQ ID NO: 1378799 - RNA, 23 nt, Human
uuuugucuuuuuacugauacuga

SEQ ID NO: 1378800 - RNA, 23 nt, Human
uuuuuucuucuauuccuguuuuu

SEQ ID NO: 1378801 - RNA, 18 nt, Human
uuuuuuuaaaaaaaaaaa

SEQ ID NO: 1378802 - RNA, 22 nt, Human
aauguucucccaagaauuugag

SEQ ID NO: 1378803 - RNA, 25 nt, Human
accacauaauaugaaaaguccacaa

SEQ ID NO: 1378804 - RNA, 25 nt, Human
accgcagcaacacugccugggccca

SEQ ID NO: 1378805 - RNA, 24 nt, Human
agaaauaguaaaacaacuuaggca

SEQ ID NO: 1378806 - RNA, 24 nt, Human
agaaauaguaaaacaacuuaggca

SEQ ID NO: 1378807 - RNA, 18 nt, Human
agaaggaaucauuuagua

SEQ ID NO: 1378808 - RNA, 21 nt, Human
aggauuggggccccuggacaa

SEQ ID NO: 1378809 - RNA, 21 nt, Human
caaaagacacgcccccgccau

SEQ ID NO: 1378810 - RNA, 22 nt, Human
caagcucacggcucucuccaga

SEQ ID NO: 1378811 - RNA, 25 nt, Human
ccaaaagacacgcccccgccauuua

SEQ ID NO: 1378812 - RNA, 19 nt, Human
cccaagaauuugagcugac

SEQ ID NO: 1378813 - RNA, 22 nt, Human
ccccuggacaagcucacggcuc

SEQ ID NO: 1378814 - RNA, 22 nt, Human
cgcaccgcgccagaaaccgguu

SEQ ID NO: 1378815 - RNA, 24 nt, Human
cuggacaagcucacggcucucucc

SEQ ID NO: 1378816 - RNA, 18 nt, Human
ggacaagcucacggcucu

SEQ ID NO: 1378817 - RNA, 21 nt, Human
uacaguguuuuuaaaaaucua

SEQ ID NO: 1378818 - RNA, 22 nt, Human
uacaguguuuuuaaaaaucuag

SEQ ID NO: 1378819 - RNA, 19 nt, Human
ucacaaagguuacaaauau

SEQ ID NO: 1378820 - RNA, 22 nt, Human
ucauuuaguauuuuacaguguu

SEQ ID NO: 1378821 - RNA, 21 nt, Human
ucucuggaaaugcauagucac

SEQ ID NO: 1378822 - RNA, 22 nt, Human
ugagcugacauuuucauaugaa

SEQ ID NO: 1378823 - RNA, 23 nt, Human
uuaaauauuacauaauuuaaugu

SEQ ID NO: 1378824 - RNA, 20 nt, Human
uuggggccccuggacaagcu

SEQ ID NO: 1378825 - RNA, 23 nt, Human
uuuucauaugaauacaauuucac

SEQ ID NO: 1378826 - RNA, 20 nt, Human
agagagaaaauugugaggag

SEQ ID NO: 1378827 - RNA, 23 nt, Human
agaucuuuagauguucugaguuu

SEQ ID NO: 1378828 - RNA, 21 nt, Human
agcaaucuuaggaaggcaaaa

SEQ ID NO: 1378829 - RNA, 19 nt, Human
aggagacgaaguaaacagg

SEQ ID NO: 1378830 - RNA, 22 nt, Human
auagagguaagagcuagaauac

SEQ ID NO: 1378831 - RNA, 26 nt, Human
ccagcaaucuuaggaaggcaaaauua

SEQ ID NO: 1378832 - RNA, 23 nt, Human
gcuguggagaaccugaauccaaa

SEQ ID NO: 1378833 - RNA, 19 nt, Human
ggccaguggaagacugcug

SEQ ID NO: 1378834 - RNA, 21 nt, Human
guaugccuuuuucucuaccaa

SEQ ID NO: 1378835 - RNA, 26 nt, Human
uaaacagaucuuuauaaucauguaaa

SEQ ID NO: 1378836 - RNA, 19 nt, Human
uacaguuucaauaccagua

SEQ ID NO: 1378837 - RNA, 19 nt, Human
ugagaaagaacauagaggu

SEQ ID NO: 1378838 - RNA, 19 nt, Human
uggccaguggaagacugcu

SEQ ID NO: 1378839 - RNA, 24 nt, Human
ugggagaagagagaaaauugugag

SEQ ID NO: 1378840 - RNA, 25 nt, Human
uggggaaaccuagcuccccucaauu

SEQ ID NO: 1378841 - RNA, 19 nt, Human
uuggcgagguuauuuucuc

SEQ ID NO: 1378842 - RNA, 25 nt, Human
uugggagaagagagaaaauugugag

SEQ ID NO: 1378843 - RNA, 23 nt, Human
uuuguuaggagacgaaguaaaca

SEQ ID NO: 1378844 - RNA, 25 nt, Human
aaaauagagucugccuggcccucuc

SEQ ID NO: 1378845 - RNA, 19 nt, Human
aaaauucucuccaccccaa

SEQ ID NO: 1378846 - RNA, 19 nt, Human
aaagaucagugguuaagag

SEQ ID NO: 1378847 - RNA, 23 nt, Human
aacaauaauaacaauacauucac

SEQ ID NO: 1378848 - RNA, 22 nt, Human
aagaagccaaaauagagucugc

SEQ ID NO: 1378849 - RNA, 19 nt, Human
aagccagauccagacguga

SEQ ID NO: 1378850 - RNA, 24 nt, Human
aaguccuugaggaagggggguggg

SEQ ID NO: 1378851 - RNA, 22 nt, Human
aauuacaggcaugagccacugc

SEQ ID NO: 1378852 - RNA, 23 nt, Human
aauuacaggcaugagccacugca

SEQ ID NO: 1378853 - RNA, 25 nt, Human
aauuccucuccacccuucuucaguu

SEQ ID NO: 1378854 - RNA, 26 nt, Human
acaacaacaacaaaacaauaauaaca

SEQ ID NO: 1378855 - RNA, 24 nt, Human
acaggcaagaaagugaaaaagaua

SEQ ID NO: 1378856 - RNA, 23 nt, Human
accagcucccuguguuuuaugcu

SEQ ID NO: 1378857 - RNA, 23 nt, Human
acccaggcuggagugcaguggug

SEQ ID NO: 1378858 - RNA, 24 nt, Human
acccaggcuggagugcaguggugu

SEQ ID NO: 1378859 - RNA, 23 nt, Human
accccgagauguguuagucuggg

SEQ ID NO: 1378860 - RNA, 19 nt, Human
accuccaucccucugccuc

SEQ ID NO: 1378861 - RNA, 27 nt, Human
agaaaaacaaacaguuccaggugcagg

SEQ ID NO: 1378862 - RNA, 18 nt, Human
agaagcaaaacaggcaag

SEQ ID NO: 1378863 - RNA, 20 nt, Human
agaagcaaaacaggcaagaa

SEQ ID NO: 1378864 - RNA, 18 nt, Human
agccucccgaguagcugg

SEQ ID NO: 1378865 - RNA, 20 nt, Human
agcgaagaagccaaaauaga

SEQ ID NO: 1378866 - RNA, 27 nt, Human
aggcaagaaagugaaaaagagggaccc

SEQ ID NO: 1378867 - RNA, 20 nt, Human
aggcccaggguuaugaacaa

SEQ ID NO: 1378868 - RNA, 25 nt, Human
aggcuggagugcaguggugugaucu

SEQ ID NO: 1378869 - RNA, 21 nt, Human
aggguuccugccucagccucc

SEQ ID NO: 1378870 - RNA, 19 nt, Human
agguaggguaucacauugg

SEQ ID NO: 1378871 - RNA, 22 nt, Human
aguagagaugggguuucgccau

SEQ ID NO: 1378872 - RNA, 18 nt, Human
aguagcugggguuacagg

SEQ ID NO: 1378873 - RNA, 22 nt, Human
agucugggcuggggagggcccu

SEQ ID NO: 1378874 - RNA, 19 nt, Human
agugcaguggugugaucuc

SEQ ID NO: 1378875 - RNA, 21 nt, Human
agugcaguggugugaucucag

SEQ ID NO: 1378876 - RNA, 23 nt, Human
agugcaguggugugaucucagcu

SEQ ID NO: 1378877 - RNA, 24 nt, Human
agugcaguggugugaucucagcuc

SEQ ID NO: 1378878 - RNA, 24 nt, Human
aguggugugaucucagcucacugc

SEQ ID NO: 1378879 - RNA, 23 nt, Human
augggguuucgccauguuggcca

SEQ ID NO: 1378880 - RNA, 24 nt, Human
augggguuucgccauguuggccag

SEQ ID NO: 1378881 - RNA, 21 nt, Human
auguagccucuacuuccucag

SEQ ID NO: 1378882 - RNA, 19 nt, Human
auguguguguaaugugugu

SEQ ID NO: 1378883 - RNA, 21 nt, Human
augugugugucauugugaugu

SEQ ID NO: 1378884 - RNA, 19 nt, Human
augugugugugaugugugu

SEQ ID NO: 1378885 - RNA, 22 nt, Human
auguuguguguguguaauguug

SEQ ID NO: 1378886 - RNA, 18 nt, Human
caaaacaggcaagaaagu

SEQ ID NO: 1378887 - RNA, 22 nt, Human
caaaauucucuccaccccaaag

SEQ ID NO: 1378888 - RNA, 21 nt, Human
caacaacaacaaaacaauaau

SEQ ID NO: 1378889 - RNA, 20 nt, Human
caacacagaaguaccuaaca

SEQ ID NO: 1378890 - RNA, 18 nt, Human
caaccucaaccuccaggg

SEQ ID NO: 1378891 - RNA, 21 nt, Human
caaccuccaggguuccugccu

SEQ ID NO: 1378892 - RNA, 18 nt, Human
cacaguaucuuaucagua

SEQ ID NO: 1378893 - RNA, 22 nt, Human
cacaugugaugaguuguggaau

SEQ ID NO: 1378894 - RNA, 24 nt, Human
cacccaggcuggagugcaguggug

SEQ ID NO: 1378895 - RNA, 23 nt, Human
cacuuguugcugaugguugcccc

SEQ ID NO: 1378896 - RNA, 19 nt, Human
cagaaaaacaaacaguucc

SEQ ID NO: 1378897 - RNA, 21 nt, Human
cagccucccgaguagcugggg

SEQ ID NO: 1378898 - RNA, 23 nt, Human
cagcucccuguguuuuaugcuuc

SEQ ID NO: 1378899 - RNA, 25 nt, Human
caggugcaggggcuuuaaaucuauc

SEQ ID NO: 1378900 - RNA, 21 nt, Human
caggugccccccaccacaccc

SEQ ID NO: 1378901 - RNA, 20 nt, Human
cagugguuaagaggcccagg

SEQ ID NO: 1378902 - RNA, 22 nt, Human
cauguuggccaggcuggucugg

SEQ ID NO: 1378903 - RNA, 24 nt, Human
ccacacugcagcaauggugggaac

SEQ ID NO: 1378904 - RNA, 22 nt, Human
ccacccuucuucaguuuguucc

SEQ ID NO: 1378905 - RNA, 19 nt, Human
ccauguuggccaggcuggu

SEQ ID NO: 1378906 - RNA, 20 nt, Human
ccauguuggccaggcugguc

SEQ ID NO: 1378907 - RNA, 21 nt, Human
cccacccaacccaccagcucc

SEQ ID NO: 1378908 - RNA, 19 nt, Human
ccccauccgacuccucccu

SEQ ID NO: 1378909 - RNA, 23 nt, Human
cccgaguagcugggguuacaggu

SEQ ID NO: 1378910 - RNA, 24 nt, Human
cccgaguagcugggguuacaggug

SEQ ID NO: 1378911 - RNA, 18 nt, Human
cccucugccucuaggagc

SEQ ID NO: 1378912 - RNA, 18 nt, Human
ccggacgaauuccuggga

SEQ ID NO: 1378913 - RNA, 28 nt, Human
ccuccagccacacugcagcaaugcucau

SEQ ID NO: 1378914 - RNA, 18 nt, Human
ccuccaugggucauuacc

SEQ ID NO: 1378915 - RNA, 18 nt, Human
ccucccuuucccuguggg

SEQ ID NO: 1378916 - RNA, 19 nt, Human
ccucuaggagccaccacuu

SEQ ID NO: 1378917 - RNA, 20 nt, Human
ccucuaggagccaccacuug

SEQ ID NO: 1378918 - RNA, 21 nt, Human
ccugacaauuccucuccaccc

SEQ ID NO: 1378919 - RNA, 24 nt, Human
ccugcauuuccacugcaaucuauc

SEQ ID NO: 1378920 - RNA, 23 nt, Human
ccugccucagccucccgaguagc

SEQ ID NO: 1378921 - RNA, 18 nt, Human
ccuugaggaaggggggug

SEQ ID NO: 1378922 - RNA, 20 nt, Human
ccuugaggaagggggguggg

SEQ ID NO: 1378923 - RNA, 21 nt, Human
ccuugaggaaggggggugggu

SEQ ID NO: 1378924 - RNA, 23 nt, Human
ccuugcucugucacccaggcugg

SEQ ID NO: 1378925 - RNA, 24 nt, Human
ccuugcucugucacccaggcugga

SEQ ID NO: 1378926 - RNA, 18 nt, Human
cgagcugaagcaauuuua

SEQ ID NO: 1378927 - RNA, 22 nt, Human
cgccauguuggccaggcugguc

SEQ ID NO: 1378928 - RNA, 24 nt, Human
cucagccucccgaguagcuggggu

SEQ ID NO: 1378929 - RNA, 18 nt, Human
cuccaggguuccugccuc

SEQ ID NO: 1378930 - RNA, 24 nt, Human
cugcaaccucaaccuccaggguuc

SEQ ID NO: 1378931 - RNA, 23 nt, Human
cugccucagccucccgaguagcu

SEQ ID NO: 1378932 - RNA, 24 nt, Human
cuggagugcaguggugugaucuca

SEQ ID NO: 1378933 - RNA, 18 nt, Human
cugucacccaggcuggag

SEQ ID NO: 1378934 - RNA, 23 nt, Human
gaacaaggucugguccucacccc

SEQ ID NO: 1378935 - RNA, 22 nt, Human
gaauuacaggcaugagccacug

SEQ ID NO: 1378936 - RNA, 18 nt, Human
gagaugggguuucgccau

SEQ ID NO: 1378937 - RNA, 24 nt, Human
gagaugggguuucgccauguuggc

SEQ ID NO: 1378938 - RNA, 18 nt, Human
gagccgagcugaagcaau

SEQ ID NO: 1378939 - RNA, 18 nt, Human
gauguguguguaaugugu

SEQ ID NO: 1378940 - RNA, 22 nt, Human
gcaaccucaaccuccaggguuc

SEQ ID NO: 1378941 - RNA, 21 nt, Human
gcgggauguagccucuacuuc

SEQ ID NO: 1378942 - RNA, 25 nt, Human
gcucugucacccaggcuggagugca

SEQ ID NO: 1378943 - RNA, 21 nt, Human
gcucuuuaggccugacaauuc

SEQ ID NO: 1378944 - RNA, 23 nt, Human
gcuggucuggagcuccugaccuc

SEQ ID NO: 1378945 - RNA, 26 nt, Human
gcuuaaguccuugaggaaggggggug

SEQ ID NO: 1378946 - RNA, 22 nt, Human
ggauguagccucuacuuccuca

SEQ ID NO: 1378947 - RNA, 19 nt, Human
ggauucccuccagccacac

SEQ ID NO: 1378948 - RNA, 22 nt, Human
ggcuggagugcaguggugugau

SEQ ID NO: 1378949 - RNA, 24 nt, Human
ggcuggucuggagcuccugaccuc

SEQ ID NO: 1378950 - RNA, 18 nt, Human
ggcuguguguauaugugu

SEQ ID NO: 1378951 - RNA, 22 nt, Human
gggguuucgccauguuggccag

SEQ ID NO: 1378952 - RNA, 23 nt, Human
guaauuuuuuguauuuuuaguag

SEQ ID NO: 1378953 - RNA, 23 nt, Human
guagagaugggguuucgccaugu

SEQ ID NO: 1378954 - RNA, 24 nt, Human
guaucacauuggaauuacaggcau

SEQ ID NO: 1378955 - RNA, 18 nt, Human
gugggugagagacugcaa

SEQ ID NO: 1378956 - RNA, 22 nt, Human
guggugugugccugcauuucca

SEQ ID NO: 1378957 - RNA, 18 nt, Human
gugugugugaugugugug

SEQ ID NO: 1378958 - RNA, 19 nt, Human
guuucagauuuuggagcau

SEQ ID NO: 1378959 - RNA, 20 nt, Human
uaaacuucguggugugugcc

SEQ ID NO: 1378960 - RNA, 25 nt, Human
uaacagaaaaacaaacaguuccagg

SEQ ID NO: 1378961 - RNA, 23 nt, Human
uaacaguaaaagaugagagauac

SEQ ID NO: 1378962 - RNA, 21 nt, Human
uaaccagcaaucauuuuccuc

SEQ ID NO: 1378963 - RNA, 24 nt, Human
uaauuuuuuguauuuuuaguagag

SEQ ID NO: 1378964 - RNA, 25 nt, Human
uaauuuuuuguauuuuuaguagaga

SEQ ID NO: 1378965 - RNA, 21 nt, Human
uacagaagcaaaacaggcaag

SEQ ID NO: 1378966 - RNA, 24 nt, Human
uacaggcaugagccacugcaccca

SEQ ID NO: 1378967 - RNA, 24 nt, Human
uacaggugccccccaccacaccca

SEQ ID NO: 1378968 - RNA, 21 nt, Human
uaccuaucuggcaugugagaa

SEQ ID NO: 1378969 - RNA, 19 nt, Human
uaccuccaucccucugccu

SEQ ID NO: 1378970 - RNA, 22 nt, Human
uagagaugggguuucgccaugu

SEQ ID NO: 1378971 - RNA, 24 nt, Human
uaguagagaugggguuucgccaug

SEQ ID NO: 1378972 - RNA, 21 nt, Human
uauacuacuaaccagcaauca

SEQ ID NO: 1378973 - RNA, 21 nt, Human
uaucaguaaucgcauucuugg

SEQ ID NO: 1378974 - RNA, 23 nt, Human
ucaaaauucucuccaccccaaag

SEQ ID NO: 1378975 - RNA, 20 nt, Human
ucacaacaacaacaaaacaa

SEQ ID NO: 1378976 - RNA, 22 nt, Human
ucacaugugaugaguuguggaa

SEQ ID NO: 1378977 - RNA, 22 nt, Human
ucacccaggcuggagugcagug

SEQ ID NO: 1378978 - RNA, 23 nt, Human
ucacugcaaccucaaccuccagg

SEQ ID NO: 1378979 - RNA, 24 nt, Human
ucacugcaaccucaaccuccaggg

SEQ ID NO: 1378980 - RNA, 20 nt, Human
ucagccucccgaguagcugg

SEQ ID NO: 1378981 - RNA, 21 nt, Human
ucagcucacugcaaccucaac

SEQ ID NO: 1378982 - RNA, 23 nt, Human
uccacccuucuucaguuuguucc

SEQ ID NO: 1378983 - RNA, 19 nt, Human
uccaugggucauuaccucc

SEQ ID NO: 1378984 - RNA, 23 nt, Human
ucccgaguagcugggguuacagg

SEQ ID NO: 1378985 - RNA, 20 nt, Human
uccuugaggaaggggggugg

SEQ ID NO: 1378986 - RNA, 25 nt, Human
uccuugaggaaggggggugggugag

SEQ ID NO: 1378987 - RNA, 22 nt, Human
ucgccauguuggccaggcuggu

SEQ ID NO: 1378988 - RNA, 24 nt, Human
ucgccauguuggccaggcuggucu

SEQ ID NO: 1378989 - RNA, 19 nt, Human
ucugggcuggggagggccc

SEQ ID NO: 1378990 - RNA, 24 nt, Human
ucugucacccaggcuggagugcag

SEQ ID NO: 1378991 - RNA, 23 nt, Human
ugagaugggagccuugcucuguc

SEQ ID NO: 1378992 - RNA, 22 nt, Human
ugcaguggugugaucucagcuc

SEQ ID NO: 1378993 - RNA, 24 nt, Human
ugcauagacccucuaauuuguaug

SEQ ID NO: 1378994 - RNA, 22 nt, Human
ugcccccacccaacccaccagc

SEQ ID NO: 1378995 - RNA, 18 nt, Human
ugccccccaccacaccca

SEQ ID NO: 1378996 - RNA, 24 nt, Human
ugccucagccucccgaguagcugg

SEQ ID NO: 1378997 - RNA, 24 nt, Human
ugcucugucacccaggcuggagug

SEQ ID NO: 1378998 - RNA, 21 nt, Human
uggaauuacaggcaugagcca

SEQ ID NO: 1378999 - RNA, 22 nt, Human
uggaauuacaggcaugagccac

SEQ ID NO: 1379000 - RNA, 22 nt, Human
uggaauuacaggcaugagccac

SEQ ID NO: 1379001 - RNA, 24 nt, Human
uggaauuacaggcaugagccacug

SEQ ID NO: 1379002 - RNA, 24 nt, Human
uggaauuacaggcaugagccacug

SEQ ID NO: 1379003 - RNA, 26 nt, Human
uggaauuacaggcaugagccacugca

SEQ ID NO: 1379004 - RNA, 20 nt, Human
uggacuugagccaacugggu

SEQ ID NO: 1379005 - RNA, 19 nt, Human
uggagugcaguggugugau

SEQ ID NO: 1379006 - RNA, 24 nt, Human
uggagugcaguggugugaucucag

SEQ ID NO: 1379007 - RNA, 24 nt, Human
uggccaggcuggucuggagcuccu

SEQ ID NO: 1379008 - RNA, 21 nt, Human
uggcccucucagcuaagggag

SEQ ID NO: 1379009 - RNA, 24 nt, Human
uggcggauugucauucuguccugg

SEQ ID NO: 1379010 - RNA, 18 nt, Human
ugggcuggggagggcccu

SEQ ID NO: 1379011 - RNA, 22 nt, Human
ugggguuacaggugccccccac

SEQ ID NO: 1379012 - RNA, 24 nt, Human
ugggguuucgccauguuggccagg

SEQ ID NO: 1379013 - RNA, 24 nt, Human
uggugugaucucagcucacugcaa

SEQ ID NO: 1379014 - RNA, 21 nt, Human
uguauuuuuaguagagauggg

SEQ ID NO: 1379015 - RNA, 22 nt, Human
ugugauguguguguaaugugug

SEQ ID NO: 1379016 - RNA, 23 nt, Human
ugugaugugugugugaugugugu

SEQ ID NO: 1379017 - RNA, 23 nt, Human
ugugauguuguguguguguaaug

SEQ ID NO: 1379018 - RNA, 18 nt, Human
uguguaauguguguuugu

SEQ ID NO: 1379019 - RNA, 18 nt, Human
uguguaauguguguuugu

SEQ ID NO: 1379020 - RNA, 18 nt, Human
uguguaauguguguuugu

SEQ ID NO: 1379021 - RNA, 18 nt, Human
uguguguauaugugugua

SEQ ID NO: 1379022 - RNA, 19 nt, Human
uguguguauauguguguaa

SEQ ID NO: 1379023 - RNA, 21 nt, Human
uguguguauauguguguaaug

SEQ ID NO: 1379024 - RNA, 25 nt, Human
uguguguauauguguguaauguugu

SEQ ID NO: 1379025 - RNA, 18 nt, Human
ugugugugaugugugugu

SEQ ID NO: 1379026 - RNA, 18 nt, Human
uguguguguaaugugugu

SEQ ID NO: 1379027 - RNA, 18 nt, Human
uguguguguaaugugugu

SEQ ID NO: 1379028 - RNA, 20 nt, Human
uguguguguguaauguugug

SEQ ID NO: 1379029 - RNA, 20 nt, Human
uguugcugaugguugccccc

SEQ ID NO: 1379030 - RNA, 20 nt, Human
uguuguguguguaaugugug

SEQ ID NO: 1379031 - RNA, 20 nt, Human
uguuguguguguaaugugug

SEQ ID NO: 1379032 - RNA, 20 nt, Human
uguuguguguguaaugugug

SEQ ID NO: 1379033 - RNA, 20 nt, Human
uguuguguguguaaugugug

SEQ ID NO: 1379034 - RNA, 21 nt, Human
uguuguguguuugucauuggu

SEQ ID NO: 1379035 - RNA, 24 nt, Human
uguuuuuuuguuuuuugagauggg

SEQ ID NO: 1379036 - RNA, 23 nt, Human
uuacagaagcaaaacaggcaaga

SEQ ID NO: 1379037 - RNA, 20 nt, Human
uuacaggugccccccaccac

SEQ ID NO: 1379038 - RNA, 18 nt, Human
uuaguagagaugggguuu

SEQ ID NO: 1379039 - RNA, 22 nt, Human
uuaguagagaugggguuucgcc

SEQ ID NO: 1379040 - RNA, 24 nt, Human
uuaguagagaugggguuucgccau

SEQ ID NO: 1379041 - RNA, 24 nt, Human
uugcucugucacccaggcuggagu

SEQ ID NO: 1379042 - RNA, 20 nt, Human
uugggugcuaucaaccggac

SEQ ID NO: 1379043 - RNA, 23 nt, Human
uuguauuuuuaguagagaugggg

SEQ ID NO: 1379044 - RNA, 21 nt, Human
uuuccacugcaaucuaucaca

SEQ ID NO: 1379045 - RNA, 24 nt, Human
uuucgccauguuggccaggcuggu

SEQ ID NO: 1379046 - RNA, 23 nt, Human
uuugagaugggagccuugcucug

SEQ ID NO: 1379047 - RNA, 23 nt, Human
uuuuuaguagagaugggguuucg

SEQ ID NO: 1379048 - RNA, 24 nt, Human
uuuuuaguagagaugggguuucgc

SEQ ID NO: 1379049 - RNA, 25 nt, Human
uuuuugagaugggagccuugcucug

SEQ ID NO: 1379050 - RNA, 21 nt, Human
uuuuuguauuuuuaguagaga

SEQ ID NO: 1379051 - RNA, 24 nt, Human
uuuuuuguauuuuuaguagagaug

SEQ ID NO: 1379052 - RNA, 19 nt, Human
aaaaaucaaucagaauuua

SEQ ID NO: 1379053 - RNA, 22 nt, Human
aaaacaaagagaaaaaguugga

SEQ ID NO: 1379054 - RNA, 21 nt, Human
aaaaucaaucagaauuuacca

SEQ ID NO: 1379055 - RNA, 21 nt, Human
aaaguucuuccaaaaacgcau

SEQ ID NO: 1379056 - RNA, 21 nt, Human
aaauagacuacagcagacaaa

SEQ ID NO: 1379057 - RNA, 24 nt, Human
aacacuggacaaaaacaaagagaa

SEQ ID NO: 1379058 - RNA, 21 nt, Human
aaugccgaugacaacagagaa

SEQ ID NO: 1379059 - RNA, 25 nt, Human
aauguuuauuuacccucaaguuuug

SEQ ID NO: 1379060 - RNA, 24 nt, Human
acagcccaggggccaaaucugguc

SEQ ID NO: 1379061 - RNA, 18 nt, Human
acagucugaaauauuuac

SEQ ID NO: 1379062 - RNA, 19 nt, Human
accacaaucaucauaaaca

SEQ ID NO: 1379063 - RNA, 21 nt, Human
acccucaaguuuuguucuagu

SEQ ID NO: 1379064 - RNA, 20 nt, Human
agaaauucuuaacaaggaca

SEQ ID NO: 1379065 - RNA, 23 nt, Human
aguaccuucuauuccucugugaa

SEQ ID NO: 1379066 - RNA, 18 nt, Human
agucugaaauauuuacaa

SEQ ID NO: 1379067 - RNA, 24 nt, Human
augacagagacuguauguggccuu

SEQ ID NO: 1379068 - RNA, 24 nt, Human
auuuauagaaacagacauauucaa

SEQ ID NO: 1379069 - RNA, 18 nt, Human
caaaaacaaagagaaaaa

SEQ ID NO: 1379070 - RNA, 27 nt, Human
caaagugcuggaagugcaauuguagua

SEQ ID NO: 1379071 - RNA, 24 nt, Human
caaccaucugugguucccacaaac

SEQ ID NO: 1379072 - RNA, 23 nt, Human
cacaaucaucauaaacaucaagg

SEQ ID NO: 1379073 - RNA, 18 nt, Human
caggggccaaaucugguc

SEQ ID NO: 1379074 - RNA, 19 nt, Human
caucacauaguaacauggg

SEQ ID NO: 1379075 - RNA, 18 nt, Human
caucauaaacaucaagua

SEQ ID NO: 1379076 - RNA, 23 nt, Human
caucuucuagccuccuucuaacc

SEQ ID NO: 1379077 - RNA, 23 nt, Human
ccggccugggaacccagcuacac

SEQ ID NO: 1379078 - RNA, 19 nt, Human
ccugcuucagaaacagagu

SEQ ID NO: 1379079 - RNA, 19 nt, Human
cuggacaaaaacaaagaga

SEQ ID NO: 1379080 - RNA, 18 nt, Human
cuuaacaaggacaaggua

SEQ ID NO: 1379081 - RNA, 26 nt, Human
cuuacuguucaaccccaaagguuuuc

SEQ ID NO: 1379082 - RNA, 20 nt, Human
gaaacugaugaaaaugguuu

SEQ ID NO: 1379083 - RNA, 27 nt, Human
gcaacacuggacaaaaacaaagagaaa

SEQ ID NO: 1379084 - RNA, 23 nt, Human
gccugaauucaucuucuagccuc

SEQ ID NO: 1379085 - RNA, 22 nt, Human
guccacacagucugaaauauuu

SEQ ID NO: 1379086 - RNA, 18 nt, Human
guggaccuuucccuaugc

SEQ ID NO: 1379087 - RNA, 22 nt, Human
uaagcgaagucuggcuaugaua

SEQ ID NO: 1379088 - RNA, 21 nt, Human
uacaaucuggcccuuuacaga

SEQ ID NO: 1379089 - RNA, 22 nt, Human
uaccaagcaauucacguaccac

SEQ ID NO: 1379090 - RNA, 24 nt, Human
uagaugaggggucagcaaacuaca

SEQ ID NO: 1379091 - RNA, 21 nt, Human
uauaaaacaccuuauaaagau

SEQ ID NO: 1379092 - RNA, 24 nt, Human
uaugauaaaguaccuucuauuccu

SEQ ID NO: 1379093 - RNA, 26 nt, Human
uauucuauuuucucuucaugguuuca

SEQ ID NO: 1379094 - RNA, 18 nt, Human
uauuuucucuucaugguu

SEQ ID NO: 1379095 - RNA, 19 nt, Human
ucaaagugcuggaagugca

SEQ ID NO: 1379096 - RNA, 20 nt, Human
ucaaagugcuggaagugcaa

SEQ ID NO: 1379097 - RNA, 24 nt, Human
uccacacagucugaaauauuuaca

SEQ ID NO: 1379098 - RNA, 19 nt, Human
ucuagugucagauacagac

SEQ ID NO: 1379099 - RNA, 18 nt, Human
ucucaaagugcuggaagu

SEQ ID NO: 1379100 - RNA, 24 nt, Human
ucucugaauuagcaccauuaguuc

SEQ ID NO: 1379101 - RNA, 20 nt, Human
ucuguaaacuaucuaauagc

SEQ ID NO: 1379102 - RNA, 22 nt, Human
ugaaauauuuacaaucuggccc

SEQ ID NO: 1379103 - RNA, 21 nt, Human
ugaggugugcugguuccauca

SEQ ID NO: 1379104 - RNA, 24 nt, Human
ugaguaguuaugacagagacugua

SEQ ID NO: 1379105 - RNA, 21 nt, Human
ugcuuacuguucaaccccaac

SEQ ID NO: 1379106 - RNA, 19 nt, Human
uggccauuuuguaccaagc

SEQ ID NO: 1379107 - RNA, 19 nt, Human
uguaccaagcaauucacgu

SEQ ID NO: 1379108 - RNA, 21 nt, Human
uguucaaccccaaccaucugu

SEQ ID NO: 1379109 - RNA, 24 nt, Human
uuagcaccauuaguucagaaauca

SEQ ID NO: 1379110 - RNA, 24 nt, Human
uucaagaaauucuuaacaaggaca

SEQ ID NO: 1379111 - RNA, 21 nt, Human
uuccucugugaacuggccauu

SEQ ID NO: 1379112 - RNA, 18 nt, Human
uucucaaagugcuggaag

SEQ ID NO: 1379113 - RNA, 22 nt, Human
uucuuccaaaaacgcauuuaaa

SEQ ID NO: 1379114 - RNA, 18 nt, Human
uuugguugaggugugcug

SEQ ID NO: 1379115 - RNA, 19 nt, Human
uuugguugaggugugcugg

SEQ ID NO: 1379116 - RNA, 19 nt, Human
aaaagccuuaccacacuca

SEQ ID NO: 1379117 - RNA, 19 nt, Human
aaagauuucccacacucaa

SEQ ID NO: 1379118 - RNA, 24 nt, Human
aaagcuuuuccacauucaucacau

SEQ ID NO: 1379119 - RNA, 19 nt, Human
aaaggagagagcuguaacu

SEQ ID NO: 1379120 - RNA, 24 nt, Human
aagccaugacccccuacauucuua

SEQ ID NO: 1379121 - RNA, 21 nt, Human
acacuggagccuuucuugcuu

SEQ ID NO: 1379122 - RNA, 23 nt, Human
accugucacauucauaggguuuc

SEQ ID NO: 1379123 - RNA, 21 nt, Human
acucacaauuauagggcugcu

SEQ ID NO: 1379124 - RNA, 18 nt, Human
acucgucacacuuaaagg

SEQ ID NO: 1379125 - RNA, 28 nt, Human
agaaaggauuccucauaauccucuagga

SEQ ID NO: 1379126 - RNA, 19 nt, Human
agagagugagcccugaaca

SEQ ID NO: 1379127 - RNA, 21 nt, Human
auaggguuucucaccugugug

SEQ ID NO: 1379128 - RNA, 20 nt, Human
augucuacugauuuugaaga

SEQ ID NO: 1379129 - RNA, 20 nt, Human
auuaugggaguucaucugaa

SEQ ID NO: 1379130 - RNA, 21 nt, Human
auucauagggccucuccccag

SEQ ID NO: 1379131 - RNA, 19 nt, Human
auuuguagggcuucucccc

SEQ ID NO: 1379132 - RNA, 19 nt, Human
cacacacaucacauuugua

SEQ ID NO: 1379133 - RNA, 18 nt, Human
cacacaucacauucauag

SEQ ID NO: 1379134 - RNA, 19 nt, Human
cacaccuaucacacacaua

SEQ ID NO: 1379135 - RNA, 19 nt, Human
cacauucaucacauguaug

SEQ ID NO: 1379136 - RNA, 18 nt, Human
cacugcccccucccaaac

SEQ ID NO: 1379137 - RNA, 19 nt, Human
cacuguguaaauuacaagc

SEQ ID NO: 1379138 - RNA, 25 nt, Human
caggauuauuaagaaacauuaauuu

SEQ ID NO: 1379139 - RNA, 19 nt, Human
caucacugcccccucccaa

SEQ ID NO: 1379140 - RNA, 19 nt, Human
cauucauagggccucuccc

SEQ ID NO: 1379141 - RNA, 20 nt, Human
cauucaucacauguaugggg

SEQ ID NO: 1379142 - RNA, 23 nt, Human
cauucaucacauguaugggguug

SEQ ID NO: 1379143 - RNA, 23 nt, Human
cauuccaucacucagaucuaagu

SEQ ID NO: 1379144 - RNA, 23 nt, Human
ccaaaaacaaucaaacauuuaac

SEQ ID NO: 1379145 - RNA, 18 nt, Human
ccacaaggagcuggcuuu

SEQ ID NO: 1379146 - RNA, 21 nt, Human
ccccauccagggcauucccuc

SEQ ID NO: 1379147 - RNA, 22 nt, Human
ccucauagguucucuucuggga

SEQ ID NO: 1379148 - RNA, 23 nt, Human
ccuugacacuggagccuuucuug

SEQ ID NO: 1379149 - RNA, 21 nt, Human
cucccaaaccaauuacaucaa

SEQ ID NO: 1379150 - RNA, 18 nt, Human
gccacuauaacuucccac

SEQ ID NO: 1379151 - RNA, 22 nt, Human
gcccccucccaaaccaauuaca

SEQ ID NO: 1379152 - RNA, 21 nt, Human
gccucuccccaguauggauuc

SEQ ID NO: 1379153 - RNA, 21 nt, Human
gccugcuacagaggcauccuc

SEQ ID NO: 1379154 - RNA, 22 nt, Human
ggccugagcuguuccugaaggc

SEQ ID NO: 1379155 - RNA, 23 nt, Human
uaaaaggaaauccaaauuuuguu

SEQ ID NO: 1379156 - RNA, 23 nt, Human
uaacacauuccaaaaacaaucaa

SEQ ID NO: 1379157 - RNA, 20 nt, Human
uaacugaaagauuucccaca

SEQ ID NO: 1379158 - RNA, 24 nt, Human
uaacugaaagauuucccacacuca

SEQ ID NO: 1379159 - RNA, 25 nt, Human
uacaacagacaacauauacaugucc

SEQ ID NO: 1379160 - RNA, 21 nt, Human
uacaauaacacauuccaaaag

SEQ ID NO: 1379161 - RNA, 24 nt, Human
uaccugaauuuccuacauuucuag

SEQ ID NO: 1379162 - RNA, 20 nt, Human
uagcuucugcaauaaaaugc

SEQ ID NO: 1379163 - RNA, 23 nt, Human
uaugggguguccugccagggugg

SEQ ID NO: 1379164 - RNA, 19 nt, Human
ucacugcccccucccaaac

SEQ ID NO: 1379165 - RNA, 21 nt, Human
ucacugcccccucccaaacca

SEQ ID NO: 1379166 - RNA, 22 nt, Human
uccacgguagaaccuuuuauug

SEQ ID NO: 1379167 - RNA, 24 nt, Human
uccacuuuaccucgccacaaggag

SEQ ID NO: 1379168 - RNA, 20 nt, Human
uccacuuuaccucgccaccg

SEQ ID NO: 1379169 - RNA, 24 nt, Human
ucccacacucaacacacuugaagg

SEQ ID NO: 1379170 - RNA, 19 nt, Human
uccucuccacgguagaacc

SEQ ID NO: 1379171 - RNA, 21 nt, Human
ucugugcugagaaaggagcga

SEQ ID NO: 1379172 - RNA, 20 nt, Human
ucuguguuuuauguccagaa

SEQ ID NO: 1379173 - RNA, 20 nt, Human
ugagaaaaaagcuuuuccac

SEQ ID NO: 1379174 - RNA, 22 nt, Human
ugagaaaaaagcuuuuccacau

SEQ ID NO: 1379175 - RNA, 21 nt, Human
ugagaaaggagagagcuguaa

SEQ ID NO: 1379176 - RNA, 25 nt, Human
ugcuacagaggcauccucauccugc

SEQ ID NO: 1379177 - RNA, 19 nt, Human
uguaauugggauucaaagc

SEQ ID NO: 1379178 - RNA, 21 nt, Human
uguaugggguguccugccagg

SEQ ID NO: 1379179 - RNA, 23 nt, Human
uuaauuuccuucucucuagauga

SEQ ID NO: 1379180 - RNA, 18 nt, Human
uuacugaaugugucaaaa

SEQ ID NO: 1379181 - RNA, 22 nt, Human
uucaugacaaagagagagugag

SEQ ID NO: 1379182 - RNA, 25 nt, Human
uuccaaaaacaaucaaacauuuaac

SEQ ID NO: 1379183 - RNA, 23 nt, Human
uucccacaccuaucacacacaua

SEQ ID NO: 1379184 - RNA, 21 nt, Human
uucccacacucaacacacuug

SEQ ID NO: 1379185 - RNA, 18 nt, Human
uucccacacucaucacau

SEQ ID NO: 1379186 - RNA, 21 nt, Human
uugaguucggagagacuuggu

SEQ ID NO: 1379187 - RNA, 19 nt, Human
uuuguagggcuucucccca

SEQ ID NO: 1379188 - RNA, 19 nt, Human
uuuuauauccuguaagagc

SEQ ID NO: 1379189 - RNA, 22 nt, Human
aaaaaaacagaccucagcugca

SEQ ID NO: 1379190 - RNA, 19 nt, Human
aaaaaaacagaccucaggg

SEQ ID NO: 1379191 - RNA, 22 nt, Human
aaaaacagaccucagcugcaua

SEQ ID NO: 1379192 - RNA, 24 nt, Human
aaaacaaaaaacgaaaaacaaaaa

SEQ ID NO: 1379193 - RNA, 19 nt, Human
aagagugaagacaauucau

SEQ ID NO: 1379194 - RNA, 18 nt, Human
aauggaauguguuuuuau

SEQ ID NO: 1379195 - RNA, 23 nt, Human
aauggcuuuuuuuuccuccuuuc

SEQ ID NO: 1379196 - RNA, 21 nt, Human
acaaagcaccuccucagcucc

SEQ ID NO: 1379197 - RNA, 20 nt, Human
acagagcuguuccucaaaag

SEQ ID NO: 1379198 - RNA, 22 nt, Human
acgaaaaacaaaaaaacagacc

SEQ ID NO: 1379199 - RNA, 18 nt, Human
agaagcccaggaacauug

SEQ ID NO: 1379200 - RNA, 33 nt, Human
auacacacacacacacacacgugaauauguggu

SEQ ID NO: 1379201 - RNA, 20 nt, Human
auccaaaaaaaucuucugua

SEQ ID NO: 1379202 - RNA, 24 nt, Human
augaaaaacaaaaaacgaaaaaca

SEQ ID NO: 1379203 - RNA, 18 nt, Human
caaaaaaacagaccucaa

SEQ ID NO: 1379204 - RNA, 18 nt, Human
caaaaaaacagaccucag

SEQ ID NO: 1379205 - RNA, 26 nt, Human
cacacacacacacacgugaauaugug

SEQ ID NO: 1379206 - RNA, 19 nt, Human
cagaagugcuuccacuuug

SEQ ID NO: 1379207 - RNA, 18 nt, Human
cagcucaugaaaauggcu

SEQ ID NO: 1379208 - RNA, 20 nt, Human
cagggcccaggugagcaaug

SEQ ID NO: 1379209 - RNA, 22 nt, Human
caggucaguaaaaauuaaaaug

SEQ ID NO: 1379210 - RNA, 28 nt, Human
caguaaaaauuaaaaugagguaauagua

SEQ ID NO: 1379211 - RNA, 21 nt, Human
caugaaaauggcuuuuuuuuc

SEQ ID NO: 1379212 - RNA, 27 nt, Human
caugagcauaacuuugugacgggcacg

SEQ ID NO: 1379213 - RNA, 18 nt, Human
ccaaaaaaaucuucugua

SEQ ID NO: 1379214 - RNA, 21 nt, Human
ccacuuugaaagaagcccagg

SEQ ID NO: 1379215 - RNA, 19 nt, Human
ccaggcucucuuuauugac

SEQ ID NO: 1379216 - RNA, 19 nt, Human
ccucaaaagcaggaaugaa

SEQ ID NO: 1379217 - RNA, 22 nt, Human
ccuucaaagaaugaagagugaa

SEQ ID NO: 1379218 - RNA, 19 nt, Human
cucuuuccuuuuuaugccc

SEQ ID NO: 1379219 - RNA, 22 nt, Human
cuguaggaaaucuccaaaauuu

SEQ ID NO: 1379220 - RNA, 23 nt, Human
cuucuuauucuuuugcuuuuuua

SEQ ID NO: 1379221 - RNA, 18 nt, Human
cuuuugcuuuuuuaaagg

SEQ ID NO: 1379222 - RNA, 21 nt, Human
gaaaaacaaaaaaacagaccu

SEQ ID NO: 1379223 - RNA, 24 nt, Human
gaaaaacaaaaaaacagaccucag

SEQ ID NO: 1379224 - RNA, 19 nt, Human
gaaagcagaggcucaggga

SEQ ID NO: 1379225 - RNA, 25 nt, Human
gcacuaggucucccaggacaaccca

SEQ ID NO: 1379226 - RNA, 18 nt, Human
gcccaggugagcaauguu

SEQ ID NO: 1379227 - RNA, 19 nt, Human
gcucagaagugcuuccacu

SEQ ID NO: 1379228 - RNA, 18 nt, Human
ggccauggagguucaaac

SEQ ID NO: 1379229 - RNA, 19 nt, Human
gggaaagcagaggcucagg

SEQ ID NO: 1379230 - RNA, 20 nt, Human
gggcccaggugagcaauguu

SEQ ID NO: 1379231 - RNA, 18 nt, Human
uaacaugaauucaacuga

SEQ ID NO: 1379232 - RNA, 20 nt, Human
uaaguccuucaaagaaugaa

SEQ ID NO: 1379233 - RNA, 33 nt, Human
uaauaaaaaaauacacacacacacacacacggu

SEQ ID NO: 1379234 - RNA, 25 nt, Human
uaauaggcuuaacccaauaagugua

SEQ ID NO: 1379235 - RNA, 22 nt, Human
uacaaagcaccuccucagcucc

SEQ ID NO: 1379236 - RNA, 18 nt, Human
uacacacacacacacaca

SEQ ID NO: 1379237 - RNA, 21 nt, Human
uagagcggggccaauucugcu

SEQ ID NO: 1379238 - RNA, 19 nt, Human
uagcagcugauuccauacu

SEQ ID NO: 1379239 - RNA, 18 nt, Human
uauguggaagaaacagca

SEQ ID NO: 1379240 - RNA, 22 nt, Human
ucaaaagcaggaaugaaaaaca

SEQ ID NO: 1379241 - RNA, 20 nt, Human
ucaaccauauucuauccccu

SEQ ID NO: 1379242 - RNA, 22 nt, Human
ucagacaauuaauccaaaaaaa

SEQ ID NO: 1379243 - RNA, 18 nt, Human
uccacaaaggcacaacua

SEQ ID NO: 1379244 - RNA, 20 nt, Human
uccagugcgcaggccccagc

SEQ ID NO: 1379245 - RNA, 20 nt, Human
uccuucuuuaaguaagaaaa

SEQ ID NO: 1379246 - RNA, 21 nt, Human
ugaaagaagcccaggaacauu

SEQ ID NO: 1379247 - RNA, 18 nt, Human
ugaagcuggggucuuggc

SEQ ID NO: 1379248 - RNA, 22 nt, Human
ugaauauguggaagaaacagca

SEQ ID NO: 1379249 - RNA, 19 nt, Human
ugacacuucaaugcuaaag

SEQ ID NO: 1379250 - RNA, 18 nt, Human
ugagacagaacagugagc

SEQ ID NO: 1379251 - RNA, 18 nt, Human
ugcaggucaguaaaaauu

SEQ ID NO: 1379252 - RNA, 22 nt, Human
ugcuggccgcagggcccaggug

SEQ ID NO: 1379253 - RNA, 22 nt, Human
ugcuuuuuuaaagguuguuaua

SEQ ID NO: 1379254 - RNA, 26 nt, Human
uggcagucacaaagcacauauaagaa

SEQ ID NO: 1379255 - RNA, 19 nt, Human
uggccgcagggcccaggug

SEQ ID NO: 1379256 - RNA, 23 nt, Human
uuagagcuagccuguuaggcugc

SEQ ID NO: 1379257 - RNA, 22 nt, Human
uucaaagaaugaagagugaaga

SEQ ID NO: 1379258 - RNA, 24 nt, Human
uucuuauucuuuugcuuuuuuaaa

SEQ ID NO: 1379259 - RNA, 18 nt, Human
uugugugaguuuuaaugu

SEQ ID NO: 1379260 - RNA, 19 nt, Human
uuuccacagagcuguuccu

SEQ ID NO: 1379261 - RNA, 21 nt, Human
uuuugcauucuuguagcagcu

SEQ ID NO: 1379262 - RNA, 23 nt, Human
aacaagaauacuuagaauucgua

SEQ ID NO: 1379263 - RNA, 22 nt, Human
aagcaggaagagaaugaacaug

SEQ ID NO: 1379264 - RNA, 27 nt, Human
aagcaggaagagaaugaacaugucuga

SEQ ID NO: 1379265 - RNA, 23 nt, Human
aagcaggaagagaaugaagggac

SEQ ID NO: 1379266 - RNA, 22 nt, Human
aaguauuuucugagagccaccc

SEQ ID NO: 1379267 - RNA, 20 nt, Human
aggccugaugauaaacagga

SEQ ID NO: 1379268 - RNA, 19 nt, Human
aggcuaauuaagugcaaca

SEQ ID NO: 1379269 - RNA, 18 nt, Human
auacaacauaugacugcc

SEQ ID NO: 1379270 - RNA, 21 nt, Human
auccucagugaucaucaaucc

SEQ ID NO: 1379271 - RNA, 24 nt, Human
augggauccagcagaaacugggcu

SEQ ID NO: 1379272 - RNA, 20 nt, Human
caaagcaguagacugugcua

SEQ ID NO: 1379273 - RNA, 18 nt, Human
caagacaaggccugauga

SEQ ID NO: 1379274 - RNA, 19 nt, Human
cagcagaaacugggcucug

SEQ ID NO: 1379275 - RNA, 20 nt, Human
ccagagcagaagcaggaaga

SEQ ID NO: 1379276 - RNA, 22 nt, Human
cccaccggcccagagcagaagc

SEQ ID NO: 1379277 - RNA, 19 nt, Human
cggcccagagcagaagcag

SEQ ID NO: 1379278 - RNA, 20 nt, Human
cuccuaagaugaggagcagg

SEQ ID NO: 1379279 - RNA, 20 nt, Human
cuggaguauugcuggcccca

SEQ ID NO: 1379280 - RNA, 18 nt, Human
gacgacucacaggcaaaa

SEQ ID NO: 1379281 - RNA, 21 nt, Human
gagaaugaacaugucugagug

SEQ ID NO: 1379282 - RNA, 24 nt, Human
gagacuccuaagaugaggagcagg

SEQ ID NO: 1379283 - RNA, 21 nt, Human
gaguguuccccuggaaggcug

SEQ ID NO: 1379284 - RNA, 21 nt, Human
gggauccagcagaaacugggc

SEQ ID NO: 1379285 - RNA, 18 nt, Human
uaucagaguuuuaaaaug

SEQ ID NO: 1379286 - RNA, 20 nt, Human
uauccaagacaaggccugau

SEQ ID NO: 1379287 - RNA, 18 nt, Human
uaugugcaauuuauucac

SEQ ID NO: 1379288 - RNA, 22 nt, Human
uauucacgauacaacauaugac

SEQ ID NO: 1379289 - RNA, 22 nt, Human
uauuugaaaaggagacuccuaa

SEQ ID NO: 1379290 - RNA, 25 nt, Human
uauuugaaaaggagacuccuaagau

SEQ ID NO: 1379291 - RNA, 21 nt, Human
ucagaguuuuaaaaugggaac

SEQ ID NO: 1379292 - RNA, 20 nt, Human
ucccaaugugccacccaugg

SEQ ID NO: 1379293 - RNA, 20 nt, Human
uccccuggaaggcugggccu

SEQ ID NO: 1379294 - RNA, 22 nt, Human
ucccuuggcaacaucaagucaa

SEQ ID NO: 1379295 - RNA, 26 nt, Human
uccuuugugguuguuauuccuuccaa

SEQ ID NO: 1379296 - RNA, 18 nt, Human
ugagagccacccaccggc

SEQ ID NO: 1379297 - RNA, 20 nt, Human
ugagagccacccaccggccc

SEQ ID NO: 1379298 - RNA, 22 nt, Human
ugaggauauacaggcuaauuaa

SEQ ID NO: 1379299 - RNA, 20 nt, Human
ugauauccaagacaaggccc

SEQ ID NO: 1379300 - RNA, 20 nt, Human
ugccaauggccucagucccu

SEQ ID NO: 1379301 - RNA, 23 nt, Human
ugcuaugagagccgguaaugagg

SEQ ID NO: 1379302 - RNA, 22 nt, Human
uggaaggcugggccuuacaagg

SEQ ID NO: 1379303 - RNA, 23 nt, Human
uggaaggcugggccuuacaagga

SEQ ID NO: 1379304 - RNA, 24 nt, Human
ugggaacagagccuaauuauuuga

SEQ ID NO: 1379305 - RNA, 21 nt, Human
ugggggagggagagaaguccc

SEQ ID NO: 1379306 - RNA, 24 nt, Human
uggguagcuacuaugugcaauuua

SEQ ID NO: 1379307 - RNA, 21 nt, Human
uuccccuggaaggcugggccu

SEQ ID NO: 1379308 - RNA, 19 nt, Human
uugcuggguagcuacuaug

SEQ ID NO: 1379309 - RNA, 23 nt, Human
uuugccagcagcaaguauuuucu

SEQ ID NO: 1379310 - RNA, 20 nt, Human
uuuuuuuuuuuuuuuuugcu

SEQ ID NO: 1379311 - RNA, 23 nt, Human
uuuuuuuuuuuuuuuuuugcugg

SEQ ID NO: 1379312 - RNA, 25 nt, Human
uuuuuuuuuuuuuuuuuuugcuggg

SEQ ID NO: 1379313 - RNA, 27 nt, Human
uuuuuuuuuuuuuuuuuuuuuuugggg

SEQ ID NO: 1379314 - RNA, 22 nt, Human
aagcaccuguaacuccaggaag

SEQ ID NO: 1379315 - RNA, 25 nt, Human
aagggccuucccaagucguuucgcc

SEQ ID NO: 1379316 - RNA, 21 nt, Human
aagugauccgccugccucggc

SEQ ID NO: 1379317 - RNA, 24 nt, Human
aagugauccgccugccucggccuc

SEQ ID NO: 1379318 - RNA, 23 nt, Human
aaugcaguuuauagcuauacauu

SEQ ID NO: 1379319 - RNA, 21 nt, Human
acagcaacaagaaacuggccu

SEQ ID NO: 1379320 - RNA, 22 nt, Human
acagcaacaagaaacuggccua

SEQ ID NO: 1379321 - RNA, 24 nt, Human
accacccugggcggccccuccaaa

SEQ ID NO: 1379322 - RNA, 24 nt, Human
accauguuggccaggcuggucucg

SEQ ID NO: 1379323 - RNA, 22 nt, Human
accccgaaagggccuucccaag

SEQ ID NO: 1379324 - RNA, 22 nt, Human
accuguaacuccaggaagauuc

SEQ ID NO: 1379325 - RNA, 19 nt, Human
acgcgcugcuggcgcugaa

SEQ ID NO: 1379326 - RNA, 26 nt, Human
acgcgcugcuggcgcugaaggaagug

SEQ ID NO: 1379327 - RNA, 18 nt, Human
acgggguuucaccauguu

SEQ ID NO: 1379328 - RNA, 23 nt, Human
acgggguuucaccauguuggcca

SEQ ID NO: 1379329 - RNA, 24 nt, Human
acgggguuucaccauguuggccag

SEQ ID NO: 1379330 - RNA, 20 nt, Human
agacgcccucaaggacaggg

SEQ ID NO: 1379331 - RNA, 24 nt, Human
agagugcagccucugccucccggg

SEQ ID NO: 1379332 - RNA, 24 nt, Human
agcgauucuccuuccucagccucc

SEQ ID NO: 1379333 - RNA, 20 nt, Human
aggaagacgcuggagcgucu

SEQ ID NO: 1379334 - RNA, 21 nt, Human
aguagcugggauuacagacau

SEQ ID NO: 1379335 - RNA, 21 nt, Human
agugcagccucugccucccgg

SEQ ID NO: 1379336 - RNA, 19 nt, Human
augacaagaacaucaggaa

SEQ ID NO: 1379337 - RNA, 21 nt, Human
caaaagacgcccucaaggaca

SEQ ID NO: 1379338 - RNA, 24 nt, Human
caacacguggcccagcaaaaggag

SEQ ID NO: 1379339 - RNA, 28 nt, Human
caaccacgcccgcccgcgcagcugcaga

SEQ ID NO: 1379340 - RNA, 20 nt, Human
caccacccagcccgcgcucc

SEQ ID NO: 1379341 - RNA, 21 nt, Human
caccacccagcccgcgcuccg

SEQ ID NO: 1379342 - RNA, 21 nt, Human
caccacguccagcuaauuuuu

SEQ ID NO: 1379343 - RNA, 21 nt, Human
caccauguuggccaggcuggu

SEQ ID NO: 1379344 - RNA, 24 nt, Human
caccauguuggccaggcuggucuc

SEQ ID NO: 1379345 - RNA, 27 nt, Human
caccauguuggccaggcuggucucgaa

SEQ ID NO: 1379346 - RNA, 20 nt, Human
cacgacgguuaaaauaauuu

SEQ ID NO: 1379347 - RNA, 21 nt, Human
cacgugcuguuugagcacgcg

SEQ ID NO: 1379348 - RNA, 19 nt, Human
cagcugcagaggccggaaa

SEQ ID NO: 1379349 - RNA, 24 nt, Human
cauguuggccaggcuggucucgaa

SEQ ID NO: 1379350 - RNA, 23 nt, Human
ccacccagcccgcgcuccgggcg

SEQ ID NO: 1379351 - RNA, 23 nt, Human
ccacccugggcggccccuccaaa

SEQ ID NO: 1379352 - RNA, 19 nt, Human
ccccggcaaccacgcccgc

SEQ ID NO: 1379353 - RNA, 19 nt, Human
cccgaguagcugggauuac

SEQ ID NO: 1379354 - RNA, 21 nt, Human
cccgcgcagcugcagaggccg

SEQ ID NO: 1379355 - RNA, 20 nt, Human
cccggguucaagcgauucuc

SEQ ID NO: 1379356 - RNA, 22 nt, Human
ccgaacccgggagcuggcgcca

SEQ ID NO: 1379357 - RNA, 24 nt, Human
ccgaguagcugggauuacagacau

SEQ ID NO: 1379358 - RNA, 20 nt, Human
ccggcucccguuccaggugc

SEQ ID NO: 1379359 - RNA, 22 nt, Human
ccucagccucccgaguagcugg

SEQ ID NO: 1379360 - RNA, 24 nt, Human
ccucccggguucaagcgauucucc

SEQ ID NO: 1379361 - RNA, 21 nt, Human
ccugaucuuaagugauccgcc

SEQ ID NO: 1379362 - RNA, 21 nt, Human
ccugcccugggaacggguucc

SEQ ID NO: 1379363 - RNA, 20 nt, Human
ccugcgccugcgccugcgcc

SEQ ID NO: 1379364 - RNA, 18 nt, Human
ccuugcucuguugcccag

SEQ ID NO: 1379365 - RNA, 19 nt, Human
ccuugcucuguugcccagg

SEQ ID NO: 1379366 - RNA, 23 nt, Human
ccuugcucuguugcccaggcuag

SEQ ID NO: 1379367 - RNA, 24 nt, Human
ccuugcucuguugcccaggcuaga

SEQ ID NO: 1379368 - RNA, 21 nt, Human
cgagccgaacccgggagcugg

SEQ ID NO: 1379369 - RNA, 25 nt, Human
cgagccgaacccgggagcuggcgcc

SEQ ID NO: 1379370 - RNA, 23 nt, Human
cgcagacagggccugggccuggg

SEQ ID NO: 1379371 - RNA, 19 nt, Human
cgccugcccugggaacggg

SEQ ID NO: 1379372 - RNA, 22 nt, Human
cgccugcgccugcccugggaac

SEQ ID NO: 1379373 - RNA, 20 nt, Human
cgcucgcccgcgcucggcac

SEQ ID NO: 1379374 - RNA, 21 nt, Human
cggcaccacccagcccgcgcu

SEQ ID NO: 1379375 - RNA, 19 nt, Human
cgggagcuggcgccauggu

SEQ ID NO: 1379376 - RNA, 21 nt, Human
cgggggccgcgcguccccggc

SEQ ID NO: 1379377 - RNA, 23 nt, Human
cgggggggcgggggcguggccuc

SEQ ID NO: 1379378 - RNA, 24 nt, Human
cgggguuucaccauguuggccagg

SEQ ID NO: 1379379 - RNA, 23 nt, Human
cucagccucccgaguagcuggga

SEQ ID NO: 1379380 - RNA, 18 nt, Human
cucagcgaucaccagcgc

SEQ ID NO: 1379381 - RNA, 23 nt, Human
cucagcgaucaccagcgcccaga

SEQ ID NO: 1379382 - RNA, 20 nt, Human
cucuguugcccaggcuagag

SEQ ID NO: 1379383 - RNA, 20 nt, Human
cugcugcagccgcagguggg

SEQ ID NO: 1379384 - RNA, 23 nt, Human
cuuaagugauccgccugccucgg

SEQ ID NO: 1379385 - RNA, 23 nt, Human
cuuccucagccucccgaguagcu

SEQ ID NO: 1379386 - RNA, 21 nt, Human
gacuucuugcuugaaaacccc

SEQ ID NO: 1379387 - RNA, 24 nt, Human
gagacgggguuucaccauguuggc

SEQ ID NO: 1379388 - RNA, 24 nt, Human
gagauggugucguccccggccucc

SEQ ID NO: 1379389 - RNA, 24 nt, Human
gaguagcugggauuacagacaugc

SEQ ID NO: 1379390 - RNA, 24 nt, Human
gaucuuaagugauccgccugccuc

SEQ ID NO: 1379391 - RNA, 24 nt, Human
gcgcagcugcagaggccggaaaag

SEQ ID NO: 1379392 - RNA, 19 nt, Human
gcgcugaaggaaguggagg

SEQ ID NO: 1379393 - RNA, 22 nt, Human
gcuagagugcagccucugccuc

SEQ ID NO: 1379394 - RNA, 25 nt, Human
gcucuguugcccaggcuagagugca

SEQ ID NO: 1379395 - RNA, 18 nt, Human
ggaaguggaggagaucag

SEQ ID NO: 1379396 - RNA, 18 nt, Human
ggacuauuaccccgaaag

SEQ ID NO: 1379397 - RNA, 23 nt, Human
ggcuggucucgaacuccugaucu

SEQ ID NO: 1379398 - RNA, 23 nt, Human
gggguuucaccauguuggccagg

SEQ ID NO: 1379399 - RNA, 21 nt, Human
gggguuucggccugcguucgg

SEQ ID NO: 1379400 - RNA, 19 nt, Human
guagagacgggguuucacc

SEQ ID NO: 1379401 - RNA, 21 nt, Human
guagagacgggguuucaccau

SEQ ID NO: 1379402 - RNA, 22 nt, Human
guagagacgggguuucaccaug

SEQ ID NO: 1379403 - RNA, 23 nt, Human
guagagacgggguuucaccaugu

SEQ ID NO: 1379404 - RNA, 22 nt, Human
guagcugggauuacagacaugc

SEQ ID NO: 1379405 - RNA, 21 nt, Human
gugcagccucugccucccggg

SEQ ID NO: 1379406 - RNA, 20 nt, Human
gugggcuccuuuggcggccc

SEQ ID NO: 1379407 - RNA, 18 nt, Human
gugggugagauccguggg

SEQ ID NO: 1379408 - RNA, 23 nt, Human
uaaagcaaaacucauuucuaaag

SEQ ID NO: 1379409 - RNA, 24 nt, Human
uaauuuuuuuauuuuuugguagag

SEQ ID NO: 1379410 - RNA, 25 nt, Human
uaauuuuuuuauuuuuugguagaga

SEQ ID NO: 1379411 - RNA, 22 nt, Human
uagagacgggguuucaccaugu

SEQ ID NO: 1379412 - RNA, 21 nt, Human
uaggaagacgcuggagcgucu

SEQ ID NO: 1379413 - RNA, 23 nt, Human
ucaaucgcuuaacaaaauaacaa

SEQ ID NO: 1379414 - RNA, 20 nt, Human
ucagccucccgaguagcugg

SEQ ID NO: 1379415 - RNA, 24 nt, Human
ucagggccgcccaagcggaggagc

SEQ ID NO: 1379416 - RNA, 21 nt, Human
ucagucugcugcagccgcagg

SEQ ID NO: 1379417 - RNA, 19 nt, Human
uccccggcaaccacgcccg

SEQ ID NO: 1379418 - RNA, 23 nt, Human
uccccuucgaaugacucuuuaaa

SEQ ID NO: 1379419 - RNA, 18 nt, Human
ucccgaguagcugggauu

SEQ ID NO: 1379420 - RNA, 21 nt, Human
ucccggguucaagcgauucuc

SEQ ID NO: 1379421 - RNA, 23 nt, Human
ucccggguucaagcgauucuccu

SEQ ID NO: 1379422 - RNA, 22 nt, Human
uccuaaagugcuggauuauagc

SEQ ID NO: 1379423 - RNA, 22 nt, Human
ucggcaccacccagcccgcgcu

SEQ ID NO: 1379424 - RNA, 18 nt, Human
ucggccuccuaaagugcu

SEQ ID NO: 1379425 - RNA, 25 nt, Human
ucgggggggcgggggcguggccucu

SEQ ID NO: 1379426 - RNA, 21 nt, Human
ucucgaacuccugaucuuaag

SEQ ID NO: 1379427 - RNA, 18 nt, Human
ucuguugcccaggcuaga

SEQ ID NO: 1379428 - RNA, 24 nt, Human
ucuguugcccaggcuagagugcag

SEQ ID NO: 1379429 - RNA, 18 nt, Human
ugaaggaaguggaggaga

SEQ ID NO: 1379430 - RNA, 19 nt, Human
ugacaagaacaucaggaac

SEQ ID NO: 1379431 - RNA, 18 nt, Human
ugaucuuaagugauccgc

SEQ ID NO: 1379432 - RNA, 24 nt, Human
ugaucuuaagugauccgccugccu

SEQ ID NO: 1379433 - RNA, 18 nt, Human
ugcagccgcaggugggug

SEQ ID NO: 1379434 - RNA, 18 nt, Human
ugcagccucugccucccg

SEQ ID NO: 1379435 - RNA, 20 nt, Human
ugcagccucugccucccggg

SEQ ID NO: 1379436 - RNA, 23 nt, Human
ugcagccucugccucccggguuc

SEQ ID NO: 1379437 - RNA, 24 nt, Human
ugcccaaaagacgcccucaaggac

SEQ ID NO: 1379438 - RNA, 26 nt, Human
ugcccaggcuagagugcagccucugc

SEQ ID NO: 1379439 - RNA, 24 nt, Human
ugccucggccuccuaaagugcugg

SEQ ID NO: 1379440 - RNA, 18 nt, Human
ugcuccaccacguccagc

SEQ ID NO: 1379441 - RNA, 18 nt, Human
ugcuguugcacgugcugu

SEQ ID NO: 1379442 - RNA, 24 nt, Human
uggccaggcuggucucgaacuccu

SEQ ID NO: 1379443 - RNA, 24 nt, Human
uggccucuggagccugguuccucc

SEQ ID NO: 1379444 - RNA, 21 nt, Human
uggcgcugaaggaaguggagg

SEQ ID NO: 1379445 - RNA, 24 nt, Human
ugggauuacagacaugcuccacca

SEQ ID NO: 1379446 - RNA, 23 nt, Human
ugguagagacgggguuucaccau

SEQ ID NO: 1379447 - RNA, 24 nt, Human
ugguagagacgggguuucaccaug

SEQ ID NO: 1379448 - RNA, 22 nt, Human
uguugcacgugcuguuugagca

SEQ ID NO: 1379449 - RNA, 21 nt, Human
uguugcccaggcuagagugca

SEQ ID NO: 1379450 - RNA, 21 nt, Human
uuaagugauccgccugccucg

SEQ ID NO: 1379451 - RNA, 21 nt, Human
uuacagacaugcuccaccacg

SEQ ID NO: 1379452 - RNA, 23 nt, Human
uucaagcgauucuccuuccucag

SEQ ID NO: 1379453 - RNA, 24 nt, Human
uucaagcgauucuccuuccucagc

SEQ ID NO: 1379454 - RNA, 24 nt, Human
uugguagagacgggguuucaccau

SEQ ID NO: 1379455 - RNA, 24 nt, Human
uuucaccauguuggccaggcuggu

SEQ ID NO: 1379456 - RNA, 24 nt, Human
uuuuugguagagacgggguuucac

SEQ ID NO: 1379457 - RNA, 23 nt, Human
uuuuuugguagagacgggguuuc

SEQ ID NO: 1379458 - RNA, 24 nt, Human
uuuuuuuauuuuuugguagagacg

SEQ ID NO: 1379459 - RNA, 18 nt, Human
aaaacagaacagaaagaa

SEQ ID NO: 1379460 - RNA, 24 nt, Human
aaagugcugggauuauaggcauga

SEQ ID NO: 1379461 - RNA, 27 nt, Human
aacauuauuucucccccccaccccccg

SEQ ID NO: 1379462 - RNA, 20 nt, Human
aaccuccaucuccugggcuc

SEQ ID NO: 1379463 - RNA, 22 nt, Human
aaguagcugggauuacaggugc

SEQ ID NO: 1379464 - RNA, 19 nt, Human
aagugcugggauuauaggc

SEQ ID NO: 1379465 - RNA, 21 nt, Human
aagugcugggauuauaggcau

SEQ ID NO: 1379466 - RNA, 22 nt, Human
acacgucauucgcauaggaaau

SEQ ID NO: 1379467 - RNA, 21 nt, Human
acacugaagcuguaacagcau

SEQ ID NO: 1379468 - RNA, 19 nt, Human
acaggguuucuucauguug

SEQ ID NO: 1379469 - RNA, 24 nt, Human
acaggguuucuucauguuggucag

SEQ ID NO: 1379470 - RNA, 22 nt, Human
acauuauuucucccccccaccc

SEQ ID NO: 1379471 - RNA, 19 nt, Human
accauggguacagggauac

SEQ ID NO: 1379472 - RNA, 24 nt, Human
acugccucagccucccaaagugcu

SEQ ID NO: 1379473 - RNA, 18 nt, Human
agacaggguuucuucaug

SEQ ID NO: 1379474 - RNA, 23 nt, Human
aggcaugagauaccgugccuggc

SEQ ID NO: 1379475 - RNA, 20 nt, Human
agugcaguggcaugaucuug

SEQ ID NO: 1379476 - RNA, 23 nt, Human
agugcaguggcaugaucuuggcu

SEQ ID NO: 1379477 - RNA, 24 nt, Human
agugcaguggcaugaucuuggcuc

SEQ ID NO: 1379478 - RNA, 24 nt, Human
aguggcaugaucuuggcucacugc

SEQ ID NO: 1379479 - RNA, 21 nt, Human
auaaaugucaauuaaagcucc

SEQ ID NO: 1379480 - RNA, 21 nt, Human
auuacaggugccugccaccau

SEQ ID NO: 1379481 - RNA, 18 nt, Human
auuauuucucccccccac

SEQ ID NO: 1379482 - RNA, 24 nt, Human
caaagugcugggauuauaggcaug

SEQ ID NO: 1379483 - RNA, 23 nt, Human
caaccuccaucuccugggcucaa

SEQ ID NO: 1379484 - RNA, 24 nt, Human
caaccuccaucuccugggcucaag

SEQ ID NO: 1379485 - RNA, 22 nt, Human
caagagagcacaaaacagaaca

SEQ ID NO: 1379486 - RNA, 22 nt, Human
caagugaaacuacuuauguaga

SEQ ID NO: 1379487 - RNA, 24 nt, Human
caccauguccggcuaauuuuugua

SEQ ID NO: 1379488 - RNA, 23 nt, Human
cacccaggagauucucauucagc

SEQ ID NO: 1379489 - RNA, 23 nt, Human
cacugcaaccuccaucuccuggg

SEQ ID NO: 1379490 - RNA, 24 nt, Human
caggguuucuucauguuggucagg

SEQ ID NO: 1379491 - RNA, 21 nt, Human
caggugccugccaccaugucc

SEQ ID NO: 1379492 - RNA, 23 nt, Human
caggugccugccaccauguccgg

SEQ ID NO: 1379493 - RNA, 24 nt, Human
ccaaagugcugggauuauaggcau

SEQ ID NO: 1379494 - RNA, 21 nt, Human
ccaaguagcugggauuacagg

SEQ ID NO: 1379495 - RNA, 20 nt, Human
ccaggagauucucauucagc

SEQ ID NO: 1379496 - RNA, 23 nt, Human
cccaaguagcugggauuacaggu

SEQ ID NO: 1379497 - RNA, 24 nt, Human
cccaaguagcugggauuacaggug

SEQ ID NO: 1379498 - RNA, 23 nt, Human
cccagucuggagugcaguggcau

SEQ ID NO: 1379499 - RNA, 22 nt, Human
ccccaccccccgcuauacuaaa

SEQ ID NO: 1379500 - RNA, 20 nt, Human
ccccccaccccccgcuauac

SEQ ID NO: 1379501 - RNA, 23 nt, Human
ccccccaccccccgcuauacuaa

SEQ ID NO: 1379502 - RNA, 19 nt, Human
ccccggggccgcgccgagg

SEQ ID NO: 1379503 - RNA, 22 nt, Human
cccgggggccucucgggagcuc

SEQ ID NO: 1379504 - RNA, 19 nt, Human
ccuccaucuccugggcuca

SEQ ID NO: 1379505 - RNA, 22 nt, Human
ccucucggggacccagaccgga

SEQ ID NO: 1379506 - RNA, 23 nt, Human
ccugacucagccucccaaguagc

SEQ ID NO: 1379507 - RNA, 23 nt, Human
ccugggcucaagcaauucuccug

SEQ ID NO: 1379508 - RNA, 21 nt, Human
ccuggucucaacugccucagc

SEQ ID NO: 1379509 - RNA, 19 nt, Human
cggaaaggcggcccuccug

SEQ ID NO: 1379510 - RNA, 23 nt, Human
cucaacugccucagccucccaaa

SEQ ID NO: 1379511 - RNA, 24 nt, Human
cucaagcaauucuccugacucagc

SEQ ID NO: 1379512 - RNA, 24 nt, Human
cucacugcaaccuccaucuccugg

SEQ ID NO: 1379513 - RNA, 24 nt, Human
cucagccucccaaguagcugggau

SEQ ID NO: 1379514 - RNA, 26 nt, Human
cuccucuacuaaaaggcucucccaaa

SEQ ID NO: 1379515 - RNA, 21 nt, Human
cuccugggcucaagcaauucu

SEQ ID NO: 1379516 - RNA, 19 nt, Human
cugaagcuguaacagcauc

SEQ ID NO: 1379517 - RNA, 23 nt, Human
cugcaaccuccaucuccugggcu

SEQ ID NO: 1379518 - RNA, 24 nt, Human
cugcaaccuccaucuccugggcuc

SEQ ID NO: 1379519 - RNA, 24 nt, Human
cugccucagccucccaaagugcug

SEQ ID NO: 1379520 - RNA, 24 nt, Human
cuggagugcaguggcaugaucuug

SEQ ID NO: 1379521 - RNA, 24 nt, Human
cuggucucaacugccucagccucc

SEQ ID NO: 1379522 - RNA, 24 nt, Human
cuucauguuggucaggcuggacuc

SEQ ID NO: 1379523 - RNA, 18 nt, Human
gagagcacaaaacagaac

SEQ ID NO: 1379524 - RNA, 22 nt, Human
gagagcacaaaacagaacagaa

SEQ ID NO: 1379525 - RNA, 18 nt, Human
gauuacaggugccugcca

SEQ ID NO: 1379526 - RNA, 24 nt, Human
gauuacaggugccugccaccaugu

SEQ ID NO: 1379527 - RNA, 24 nt, Human
gauuauaggcaugagauaccgugc

SEQ ID NO: 1379528 - RNA, 21 nt, Human
gccgcgccgaggggacaggug

SEQ ID NO: 1379529 - RNA, 21 nt, Human
gcucucccaaaagagacacag

SEQ ID NO: 1379530 - RNA, 24 nt, Human
ggcuggacucgaacuccuggucuc

SEQ ID NO: 1379531 - RNA, 21 nt, Human
gggaaaugcauccauugcccc

SEQ ID NO: 1379532 - RNA, 18 nt, Human
guagcugggauuacaggu

SEQ ID NO: 1379533 - RNA, 21 nt, Human
gucaauuaaagcuccuuuaag

SEQ ID NO: 1379534 - RNA, 22 nt, Human
gucucaacugccucagccuccc

SEQ ID NO: 1379535 - RNA, 25 nt, Human
uaacauuauuucucccccccacccc

SEQ ID NO: 1379536 - RNA, 24 nt, Human
uaauuuuuguauuuuuaguacaga

SEQ ID NO: 1379537 - RNA, 26 nt, Human
uaggaggcuuaaaacacaauuauuca

SEQ ID NO: 1379538 - RNA, 24 nt, Human
uaguacagacaggguuucuucaug

SEQ ID NO: 1379539 - RNA, 24 nt, Human
ucacugcaaccuccaucuccuggg

SEQ ID NO: 1379540 - RNA, 25 nt, Human
ucacugcaaccuccaucuccugggc

SEQ ID NO: 1379541 - RNA, 27 nt, Human
ucacugcaaccuccaucuccugggcuc

SEQ ID NO: 1379542 - RNA, 20 nt, Human
ucagccucccaaguagcugg

SEQ ID NO: 1379543 - RNA, 24 nt, Human
ucccaaagugcugggauuauaggc

SEQ ID NO: 1379544 - RNA, 23 nt, Human
ucccaaguagcugggauuacagg

SEQ ID NO: 1379545 - RNA, 23 nt, Human
ucccccccaccccccgcuauacu

SEQ ID NO: 1379546 - RNA, 18 nt, Human
uccccggggccgcgccga

SEQ ID NO: 1379547 - RNA, 21 nt, Human
ucccgggggccucucgggagc

SEQ ID NO: 1379548 - RNA, 22 nt, Human
uccuggacaggugacacacacu

SEQ ID NO: 1379549 - RNA, 21 nt, Human
uccugggcucaagcaauucuc

SEQ ID NO: 1379550 - RNA, 22 nt, Human
uccugggcucaagcaauucucc

SEQ ID NO: 1379551 - RNA, 24 nt, Human
uccugggcucaagcaauucuccug

SEQ ID NO: 1379552 - RNA, 24 nt, Human
ucucccucuguugcccagucugga

SEQ ID NO: 1379553 - RNA, 24 nt, Human
ucuccugggcucaagcaauucucc

SEQ ID NO: 1379554 - RNA, 20 nt, Human
ucucggggacccagaccgga

SEQ ID NO: 1379555 - RNA, 24 nt, Human
ucuguugcccagucuggagugcag

SEQ ID NO: 1379556 - RNA, 24 nt, Human
ugacucagccucccaaguagcugg

SEQ ID NO: 1379557 - RNA, 22 nt, Human
ugagacggagucucccucuguu

SEQ ID NO: 1379558 - RNA, 25 nt, Human
ugcaaccuccaucuccugggcucaa

SEQ ID NO: 1379559 - RNA, 22 nt, Human
ugcaguggcaugaucuuggcuc

SEQ ID NO: 1379560 - RNA, 24 nt, Human
ugccucagccucccaaagugcugg

SEQ ID NO: 1379561 - RNA, 19 nt, Human
uggagugcaguggcaugau

SEQ ID NO: 1379562 - RNA, 24 nt, Human
uggagugcaguggcaugaucuugg

SEQ ID NO: 1379563 - RNA, 19 nt, Human
uggcaugaucuuggcucac

SEQ ID NO: 1379564 - RNA, 21 nt, Human
uggcaugaucuuggcucacug

SEQ ID NO: 1379565 - RNA, 21 nt, Human
ugggauuacaggugccugcca

SEQ ID NO: 1379566 - RNA, 22 nt, Human
ugggauuacaggugccugccac

SEQ ID NO: 1379567 - RNA, 24 nt, Human
ugggauuacaggugccugccacca

SEQ ID NO: 1379568 - RNA, 25 nt, Human
ugggauuacaggugccugccaccau

SEQ ID NO: 1379569 - RNA, 18 nt, Human
ugggauuauaggcaugag

SEQ ID NO: 1379570 - RNA, 19 nt, Human
ugggauuauaggcaugaga

SEQ ID NO: 1379571 - RNA, 22 nt, Human
ugggauuauaggcaugagauac

SEQ ID NO: 1379572 - RNA, 23 nt, Human
ugggauuauaggcaugagauacc

SEQ ID NO: 1379573 - RNA, 23 nt, Human
ugggauuauaggcaugagauacc

SEQ ID NO: 1379574 - RNA, 24 nt, Human
ugggauuauaggcaugagauaccg

SEQ ID NO: 1379575 - RNA, 24 nt, Human
uggucaggcuggacucgaacuccu

SEQ ID NO: 1379576 - RNA, 19 nt, Human
uguagagacucauauaaga

SEQ ID NO: 1379577 - RNA, 24 nt, Human
uuaguacagacaggguuucuucau

SEQ ID NO: 1379578 - RNA, 18 nt, Human
uucauguuggucaggcug

SEQ ID NO: 1379579 - RNA, 22 nt, Human
uucucccccccaccccccgcua

SEQ ID NO: 1379580 - RNA, 24 nt, Human
uugcccagucuggagugcaguggc

SEQ ID NO: 1379581 - RNA, 20 nt, Human
uuuacuuuuacuuaggaggc

SEQ ID NO: 1379582 - RNA, 21 nt, Human
uuucuucauguuggucaggcu

SEQ ID NO: 1379583 - RNA, 22 nt, Human
uuuguuaacuucugaacuuggu

SEQ ID NO: 1379584 - RNA, 20 nt, Human
uuuuuguauuuuuaguacag

SEQ ID NO: 1379585 - RNA, 23 nt, Human
uuuuuguauuuuuaguacagaca

SEQ ID NO: 1379586 - RNA, 23 nt, Human
aaaaacaacaacaaaaaccaaag

SEQ ID NO: 1379587 - RNA, 19 nt, Human
aaaaacagagagaggaagg

SEQ ID NO: 1379588 - RNA, 19 nt, Human
aaaaaccaaagagcuguaa

SEQ ID NO: 1379589 - RNA, 21 nt, Human
aaaacguaaaaacaacaacaa

SEQ ID NO: 1379590 - RNA, 22 nt, Human
aaaauagguuauuuaaaaaugu

SEQ ID NO: 1379591 - RNA, 19 nt, Human
aaacaacaacaaaaaccaa

SEQ ID NO: 1379592 - RNA, 24 nt, Human
aaacaacaacaaaaaccaaagagc

SEQ ID NO: 1379593 - RNA, 26 nt, Human
aaacaacaacaaaaaccaaagagcug

SEQ ID NO: 1379594 - RNA, 21 nt, Human
aaacagaauaugccgggccca

SEQ ID NO: 1379595 - RNA, 20 nt, Human
aaaguacugggauuauaggc

SEQ ID NO: 1379596 - RNA, 22 nt, Human
aaaguacugggauuauaggcga

SEQ ID NO: 1379597 - RNA, 24 nt, Human
aaagugcugggauuacaggcauga

SEQ ID NO: 1379598 - RNA, 24 nt, Human
aaagugcugggauuacaggcguga

SEQ ID NO: 1379599 - RNA, 19 nt, Human
aaaucaggcacaaaaagac

SEQ ID NO: 1379600 - RNA, 23 nt, Human
aacagaaugagaccugucucuga

SEQ ID NO: 1379601 - RNA, 24 nt, Human
aacaucuuuuaucuuuuuuuuuuu

SEQ ID NO: 1379602 - RNA, 26 nt, Human
aacuauaggagcaaaugugaaggaaa

SEQ ID NO: 1379603 - RNA, 24 nt, Human
aagaagcugggauuauaggcgccu

SEQ ID NO: 1379604 - RNA, 25 nt, Human
aagcaauccucccacuucagccucc

SEQ ID NO: 1379605 - RNA, 18 nt, Human
aaguacugggauuauagg

SEQ ID NO: 1379606 - RNA, 19 nt, Human
aagugcugggauuacaggc

SEQ ID NO: 1379607 - RNA, 19 nt, Human
aagugcugggauuacaggc

SEQ ID NO: 1379608 - RNA, 19 nt, Human
aagugcugggauuacaggc

SEQ ID NO: 1379609 - RNA, 21 nt, Human
aagugcugggauuacaggcau

SEQ ID NO: 1379610 - RNA, 26 nt, Human
aagugcugggauuacaggcaugagcc

SEQ ID NO: 1379611 - RNA, 26 nt, Human
aagugcugggauuacaggcgugagcc

SEQ ID NO: 1379612 - RNA, 19 nt, Human
aaugaucuacccaccuugg

SEQ ID NO: 1379613 - RNA, 19 nt, Human
aauggaacacaccaacaaa

SEQ ID NO: 1379614 - RNA, 24 nt, Human
aaugggauuugccauguuggccag

SEQ ID NO: 1379615 - RNA, 27 nt, Human
acaaaaaccaaagagcuguaauaaaug

SEQ ID NO: 1379616 - RNA, 23 nt, Human
acaacaacaaaaaccaaagagcu

SEQ ID NO: 1379617 - RNA, 18 nt, Human
acagaauaugccgggccc

SEQ ID NO: 1379618 - RNA, 21 nt, Human
acagaauguacaaugaagccc

SEQ ID NO: 1379619 - RNA, 18 nt, Human
acagacaugcaucaccau

SEQ ID NO: 1379620 - RNA, 21 nt, Human
acagagccagaguccugucag

SEQ ID NO: 1379621 - RNA, 23 nt, Human
acagagccagaguccugucagug

SEQ ID NO: 1379622 - RNA, 18 nt, Human
accauguuggccaggcug

SEQ ID NO: 1379623 - RNA, 23 nt, Human
accucaaccuuccaaagugcugg

SEQ ID NO: 1379624 - RNA, 19 nt, Human
acugcaaccuccgcccccu

SEQ ID NO: 1379625 - RNA, 23 nt, Human
acuucagccuccugaguggcugg

SEQ ID NO: 1379626 - RNA, 24 nt, Human
acuucagccuccugaguggcuggg

SEQ ID NO: 1379627 - RNA, 21 nt, Human
agaaacagagccagaguccug

SEQ ID NO: 1379628 - RNA, 27 nt, Human
agacacuguccuccugcagcuucuuuc

SEQ ID NO: 1379629 - RNA, 22 nt, Human
agagaagcacagcagagcccca

SEQ ID NO: 1379630 - RNA, 24 nt, Human
agagaucugcccaccucaaccuuc

SEQ ID NO: 1379631 - RNA, 25 nt, Human
agcaauccucccacuucagccuccu

SEQ ID NO: 1379632 - RNA, 20 nt, Human
aggaggaggucaaggcugcc

SEQ ID NO: 1379633 - RNA, 20 nt, Human
aggcagaacagucaaaaaca

SEQ ID NO: 1379634 - RNA, 19 nt, Human
aggcagguuggacugcuuc

SEQ ID NO: 1379635 - RNA, 21 nt, Human
aggcgagagccaccacgccca

SEQ ID NO: 1379636 - RNA, 20 nt, Human
aggcgccugccaccacgccc

SEQ ID NO: 1379637 - RNA, 25 nt, Human
aggcuggagugcagugucgcaaucu

SEQ ID NO: 1379638 - RNA, 19 nt, Human
agggauggaguuucaccau

SEQ ID NO: 1379639 - RNA, 24 nt, Human
aggugauccgccugccucagccuc

SEQ ID NO: 1379640 - RNA, 21 nt, Human
aguagaaaugggauuugccau

SEQ ID NO: 1379641 - RNA, 18 nt, Human
agucaaacugagcugagg

SEQ ID NO: 1379642 - RNA, 19 nt, Human
agucucagagaagcacagc

SEQ ID NO: 1379643 - RNA, 20 nt, Human
agugcaauggugugaucgug

SEQ ID NO: 1379644 - RNA, 23 nt, Human
agugcaauggugugaucguggcu

SEQ ID NO: 1379645 - RNA, 24 nt, Human
agugcaauggugugaucguggcuc

SEQ ID NO: 1379646 - RNA, 20 nt, Human
agugcagugucgcaaucuug

SEQ ID NO: 1379647 - RNA, 24 nt, Human
agugcagugucgcaaucuuggcuc

SEQ ID NO: 1379648 - RNA, 18 nt, Human
agugcugggauuacaggc

SEQ ID NO: 1379649 - RNA, 18 nt, Human
agugcugggauuacaggc

SEQ ID NO: 1379650 - RNA, 21 nt, Human
aguggcugggacuacagacau

SEQ ID NO: 1379651 - RNA, 23 nt, Human
aguggcugggacuacagacaugc

SEQ ID NO: 1379652 - RNA, 20 nt, Human
auaaacagugauacguacau

SEQ ID NO: 1379653 - RNA, 24 nt, Human
augaucuacccaccuuggccuccc

SEQ ID NO: 1379654 - RNA, 18 nt, Human
auggaguuucaccauguu

SEQ ID NO: 1379655 - RNA, 22 nt, Human
auggaguuucaccauguuggcc

SEQ ID NO: 1379656 - RNA, 24 nt, Human
auggaguuucaccauguuggccag

SEQ ID NO: 1379657 - RNA, 24 nt, Human
augggauuugccauguuggccagg

SEQ ID NO: 1379658 - RNA, 21 nt, Human
augugcacugagaaaggauaa

SEQ ID NO: 1379659 - RNA, 24 nt, Human
auuuuucuauuuuuaguagggaug

SEQ ID NO: 1379660 - RNA, 23 nt, Human
caaaagacucuacuugaacaagg

SEQ ID NO: 1379661 - RNA, 22 nt, Human
caaaguacugggauuauaggcg

SEQ ID NO: 1379662 - RNA, 24 nt, Human
caaagugcugggauuacaggcaug

SEQ ID NO: 1379663 - RNA, 24 nt, Human
caaagugcugggauuacaggcgug

SEQ ID NO: 1379664 - RNA, 23 nt, Human
caacaaaaaccaaagagcuguaa

SEQ ID NO: 1379665 - RNA, 18 nt, Human
caaccgccuaggcucaag

SEQ ID NO: 1379666 - RNA, 23 nt, Human
caagugauuucuccugccucagc

SEQ ID NO: 1379667 - RNA, 23 nt, Human
cacagcagagccccaguccugcc

SEQ ID NO: 1379668 - RNA, 24 nt, Human
caccacgcccggcuaauuuuugua

SEQ ID NO: 1379669 - RNA, 24 nt, Human
caccaggcuggagugcaauggugu

SEQ ID NO: 1379670 - RNA, 21 nt, Human
caccauguuggccaggcuggu

SEQ ID NO: 1379671 - RNA, 24 nt, Human
caccauguuggccaggcuggucuc

SEQ ID NO: 1379672 - RNA, 27 nt, Human
caccauguuggccaggcuggucucaaa

SEQ ID NO: 1379673 - RNA, 22 nt, Human
caccuaauggaacacaccaaca

SEQ ID NO: 1379674 - RNA, 21 nt, Human
cacugcaaccuccgcccccug

SEQ ID NO: 1379675 - RNA, 22 nt, Human
cacugcaaccuccgccuccggg

SEQ ID NO: 1379676 - RNA, 25 nt, Human
cagaacagucaaaaacagagagagg

SEQ ID NO: 1379677 - RNA, 20 nt, Human
cagaguccugucagugaaag

SEQ ID NO: 1379678 - RNA, 22 nt, Human
cagccccgagguggcagucagg

SEQ ID NO: 1379679 - RNA, 20 nt, Human
cagccuccugaguagcuggg

SEQ ID NO: 1379680 - RNA, 20 nt, Human
cagccuccugaguggcuggg

SEQ ID NO: 1379681 - RNA, 21 nt, Human
cagcuucuuucagucuguauc

SEQ ID NO: 1379682 - RNA, 22 nt, Human
caggugauccgccugccucagc

SEQ ID NO: 1379683 - RNA, 21 nt, Human
caguggccacagucuuggcuc

SEQ ID NO: 1379684 - RNA, 21 nt, Human
cauguugcccaggcuggucuc

SEQ ID NO: 1379685 - RNA, 24 nt, Human
cauguugcccaggcuggucucgaa

SEQ ID NO: 1379686 - RNA, 24 nt, Human
cauguuggccaggcuggucucaaa

SEQ ID NO: 1379687 - RNA, 24 nt, Human
cauguuggccaggcuggucucgaa

SEQ ID NO: 1379688 - RNA, 18 nt, Human
ccaaaguacugggauuau

SEQ ID NO: 1379689 - RNA, 22 nt, Human
ccaaagugcugggauuacaggc

SEQ ID NO: 1379690 - RNA, 22 nt, Human
ccaaagugcugggauuacaggc

SEQ ID NO: 1379691 - RNA, 22 nt, Human
ccaaagugcugggauuacaggc

SEQ ID NO: 1379692 - RNA, 24 nt, Human
ccaaagugcugggauuacaggcau

SEQ ID NO: 1379693 - RNA, 24 nt, Human
ccaaagugcugggauuacaggcgu

SEQ ID NO: 1379694 - RNA, 20 nt, Human
ccaccacgcccggcuaauuu

SEQ ID NO: 1379695 - RNA, 18 nt, Human
ccaguccugccugaccag

SEQ ID NO: 1379696 - RNA, 19 nt, Human
ccauguugcccaggcuggu

SEQ ID NO: 1379697 - RNA, 22 nt, Human
ccauguugcccaggcuggucuc

SEQ ID NO: 1379698 - RNA, 23 nt, Human
ccauguugcccaggcuggucucg

SEQ ID NO: 1379699 - RNA, 19 nt, Human
ccauguuggccaggcuggu

SEQ ID NO: 1379700 - RNA, 23 nt, Human
ccauguuggccaggcuggucucg

SEQ ID NO: 1379701 - RNA, 23 nt, Human
cccaagaagcugggauuauaggc

SEQ ID NO: 1379702 - RNA, 24 nt, Human
cccaagaagcugggauuauaggcg

SEQ ID NO: 1379703 - RNA, 24 nt, Human
cccacuucagccuccugaguggcu

SEQ ID NO: 1379704 - RNA, 18 nt, Human
cccagccgggaaaagagg

SEQ ID NO: 1379705 - RNA, 20 nt, Human
cccaggaggaggucaaggcu

SEQ ID NO: 1379706 - RNA, 21 nt, Human
cccgaucucaggugauccgcc

SEQ ID NO: 1379707 - RNA, 22 nt, Human
cccuggguucaagugauuucuc

SEQ ID NO: 1379708 - RNA, 25 nt, Human
cccuggguucaagugauuucuccug

SEQ ID NO: 1379709 - RNA, 24 nt, Human
ccgcccccuggguucaagugauuu

SEQ ID NO: 1379710 - RNA, 25 nt, Human
ccgccugccucagccucccaaagua

SEQ ID NO: 1379711 - RNA, 23 nt, Human
ccgggguucaagugauuuuccug

SEQ ID NO: 1379712 - RNA, 22 nt, Human
ccuaauggaacacaccaacaaa

SEQ ID NO: 1379713 - RNA, 18 nt, Human
ccucaagagaucugccca

SEQ ID NO: 1379714 - RNA, 24 nt, Human
ccucccacuucagccuccugagug

SEQ ID NO: 1379715 - RNA, 20 nt, Human
ccuccgggguucaagugauu

SEQ ID NO: 1379716 - RNA, 20 nt, Human
ccucugugcucuagccuugg

SEQ ID NO: 1379717 - RNA, 19 nt, Human
ccugaccucaagagaucug

SEQ ID NO: 1379718 - RNA, 24 nt, Human
ccugagcugaaaugaucuacccac

SEQ ID NO: 1379719 - RNA, 21 nt, Human
ccugaguagcugggauuacau

SEQ ID NO: 1379720 - RNA, 19 nt, Human
ccugaguggcugggacuac

SEQ ID NO: 1379721 - RNA, 19 nt, Human
ccugccacagccucccaag

SEQ ID NO: 1379722 - RNA, 23 nt, Human
ccugccucagccuccugaguagc

SEQ ID NO: 1379723 - RNA, 24 nt, Human
ccuggguucaagugauuucucccc

SEQ ID NO: 1379724 - RNA, 24 nt, Human
ccuggguucaagugauuucuccug

SEQ ID NO: 1379725 - RNA, 21 nt, Human
ccuuuagucccagcuacucag

SEQ ID NO: 1379726 - RNA, 22 nt, Human
cgagguggcagucaggcccacc

SEQ ID NO: 1379727 - RNA, 18 nt, Human
cgaucucaggugauccgc

SEQ ID NO: 1379728 - RNA, 24 nt, Human
cgaucucaggugauccgccugccu

SEQ ID NO: 1379729 - RNA, 23 nt, Human
cgcacaccaccaugaccagcuaa

SEQ ID NO: 1379730 - RNA, 22 nt, Human
cgcccccuggguucaagugauu

SEQ ID NO: 1379731 - RNA, 19 nt, Human
cucaagagaucugcccacc

SEQ ID NO: 1379732 - RNA, 24 nt, Human
cucaagcaauccucccacuucagc

SEQ ID NO: 1379733 - RNA, 23 nt, Human
cucacugcaaccuccgccuccgg

SEQ ID NO: 1379734 - RNA, 23 nt, Human
cucagccuccugaguagcuggga

SEQ ID NO: 1379735 - RNA, 21 nt, Human
cucaggugauccgccugccuc

SEQ ID NO: 1379736 - RNA, 23 nt, Human
cucaggugauccgccugccucag

SEQ ID NO: 1379737 - RNA, 24 nt, Human
cucgcucugucgcccaggcuggag

SEQ ID NO: 1379738 - RNA, 20 nt, Human
cucugucgcccaggcuggag

SEQ ID NO: 1379739 - RNA, 24 nt, Human
cugaaaugaucuacccaccuuggc

SEQ ID NO: 1379740 - RNA, 23 nt, Human
cugcaaccuccgcccccuggguu

SEQ ID NO: 1379741 - RNA, 24 nt, Human
cugcaaccuccgcccccuggguuc

SEQ ID NO: 1379742 - RNA, 24 nt, Human
cugcaaccuccgccuccgggguuc

SEQ ID NO: 1379743 - RNA, 20 nt, Human
cugcagcuucuuucagucug

SEQ ID NO: 1379744 - RNA, 23 nt, Human
cugccucagccuccugaguagcu

SEQ ID NO: 1379745 - RNA, 18 nt, Human
cuguaugauuccauucac

SEQ ID NO: 1379746 - RNA, 19 nt, Human
cuuaaguucuuucauuaca

SEQ ID NO: 1379747 - RNA, 24 nt, Human
gaaaugcucaaaaucuagacagaa

SEQ ID NO: 1379748 - RNA, 21 nt, Human
gaacaagcagacacuguccuc

SEQ ID NO: 1379749 - RNA, 18 nt, Human
gaagcugggauuauaggc

SEQ ID NO: 1379750 - RNA, 24 nt, Human
gaccucaagagaucugcccaccuc

SEQ ID NO: 1379751 - RNA, 20 nt, Human
gagaggaaggagaauggugg

SEQ ID NO: 1379752 - RNA, 20 nt, Human
gagaugggguuuugccaugu

SEQ ID NO: 1379753 - RNA, 24 nt, Human
gagcugaaaugaucuacccaccuu

SEQ ID NO: 1379754 - RNA, 21 nt, Human
gaggcagaacagucaaaaaca

SEQ ID NO: 1379755 - RNA, 26 nt, Human
gaguagcugggauuacaugcgcacac

SEQ ID NO: 1379756 - RNA, 21 nt, Human
gauccgccugccucagccucc

SEQ ID NO: 1379757 - RNA, 23 nt, Human
gaucucaggugauccgccugccu

SEQ ID NO: 1379758 - RNA, 18 nt, Human
gauuacaggcaugagcca

SEQ ID NO: 1379759 - RNA, 21 nt, Human
gauuacaggcaugagccauug

SEQ ID NO: 1379760 - RNA, 24 nt, Human
gauuacaggcaugagccauugugc

SEQ ID NO: 1379761 - RNA, 18 nt, Human
gauuacaggcgugagcca

SEQ ID NO: 1379762 - RNA, 18 nt, Human
gauuauaggcgagagcca

SEQ ID NO: 1379763 - RNA, 22 nt, Human
gcaaccuccgccuccgggguuc

SEQ ID NO: 1379764 - RNA, 20 nt, Human
gccauguugcccaggcuggu

SEQ ID NO: 1379765 - RNA, 21 nt, Human
gcccaggcuggagugcagugu

SEQ ID NO: 1379766 - RNA, 22 nt, Human
gcccggcuaauuuuuguauuuu

SEQ ID NO: 1379767 - RNA, 24 nt, Human
gccuaggcucaagcaauccuccca

SEQ ID NO: 1379768 - RNA, 21 nt, Human
gccucugugcucuagccuugg

SEQ ID NO: 1379769 - RNA, 18 nt, Human
gcgcacaccaccaugacc

SEQ ID NO: 1379770 - RNA, 19 nt, Human
gcgcacaccaccaugacca

SEQ ID NO: 1379771 - RNA, 25 nt, Human
gcucugucgcccaggcuggagugca

SEQ ID NO: 1379772 - RNA, 25 nt, Human
gcucuguugcccagacuggagucca

SEQ ID NO: 1379773 - RNA, 23 nt, Human
gcuggucucgaacuccugaccuc

SEQ ID NO: 1379774 - RNA, 23 nt, Human
ggaccugcuggggaaauuuuccu

SEQ ID NO: 1379775 - RNA, 19 nt, Human
ggaggccagcuggguacaa

SEQ ID NO: 1379776 - RNA, 22 nt, Human
ggaguuucaccauguuggccag

SEQ ID NO: 1379777 - RNA, 24 nt, Human
ggauuacaggcaugagccauugug

SEQ ID NO: 1379778 - RNA, 22 nt, Human
ggcuggagugcaauggugugau

SEQ ID NO: 1379779 - RNA, 24 nt, Human
ggcuggucucgaacuccugaccuc

SEQ ID NO: 1379780 - RNA, 21 nt, Human
gggauuugccauguuggccag

SEQ ID NO: 1379781 - RNA, 23 nt, Human
gggguucaagugauuuuccugcc

SEQ ID NO: 1379782 - RNA, 22 nt, Human
gggguuuugccauguugcccag

SEQ ID NO: 1379783 - RNA, 23 nt, Human
gggguuuugccauguugcccagg

SEQ ID NO: 1379784 - RNA, 19 nt, Human
ggguucaagugauuuuccu

SEQ ID NO: 1379785 - RNA, 22 nt, Human
ggguuuugccauguugcccagg

SEQ ID NO: 1379786 - RNA, 19 nt, Human
ggucucgaacuccugaccu

SEQ ID NO: 1379787 - RNA, 23 nt, Human
gguucugucaccaggcuggagug

SEQ ID NO: 1379788 - RNA, 19 nt, Human
guagagaugggguuuugcc

SEQ ID NO: 1379789 - RNA, 21 nt, Human
guagagaugggguuuugccau

SEQ ID NO: 1379790 - RNA, 22 nt, Human
guagagaugggguuuugccaug

SEQ ID NO: 1379791 - RNA, 19 nt, Human
guauuuuuuguagagaugg

SEQ ID NO: 1379792 - RNA, 21 nt, Human
gucaaaaacagagagaggaag

SEQ ID NO: 1379793 - RNA, 24 nt, Human
gucaaaaacagagagaggaaggag

SEQ ID NO: 1379794 - RNA, 18 nt, Human
gugauccgccugccucag

SEQ ID NO: 1379795 - RNA, 24 nt, Human
gugauccgccugccucagccuccc

SEQ ID NO: 1379796 - RNA, 24 nt, Human
gugauuuuccugccacagccuccc

SEQ ID NO: 1379797 - RNA, 24 nt, Human
guuuugccauguugcccaggcugg

SEQ ID NO: 1379798 - RNA, 24 nt, Human
uaaaaacaacaacaaaaaccaaag

SEQ ID NO: 1379799 - RNA, 21 nt, Human
uaaaugacacacaauuuagaa

SEQ ID NO: 1379800 - RNA, 19 nt, Human
uaacuagacagacgacuga

SEQ ID NO: 1379801 - RNA, 21 nt, Human
uaacugauacugagaucaaaa

SEQ ID NO: 1379802 - RNA, 19 nt, Human
uaagaaagagcaacagucg

SEQ ID NO: 1379803 - RNA, 21 nt, Human
uaauuuuucuauuuuuaguag

SEQ ID NO: 1379804 - RNA, 24 nt, Human
uaauuuuucuauuuuuaguaggga

SEQ ID NO: 1379805 - RNA, 22 nt, Human
uaauuuuuguauuuuuaguaga

SEQ ID NO: 1379806 - RNA, 24 nt, Human
uaauuuuuguauuuuuuguagaga

SEQ ID NO: 1379807 - RNA, 23 nt, Human
uacaaugaagcccaacuauagga

SEQ ID NO: 1379808 - RNA, 24 nt, Human
uacagccccgagguggcagucagg

SEQ ID NO: 1379809 - RNA, 22 nt, Human
uacaggcaugagccauugugcc

SEQ ID NO: 1379810 - RNA, 22 nt, Human
uacaggcgugagccaaaaguca

SEQ ID NO: 1379811 - RNA, 22 nt, Human
uacccaccuuggccucccaaag

SEQ ID NO: 1379812 - RNA, 23 nt, Human
uacccaccuuggccucccaaagu

SEQ ID NO: 1379813 - RNA, 21 nt, Human
uagaaaugggauuugccaugu

SEQ ID NO: 1379814 - RNA, 22 nt, Human
uagagaugggguuuugccaugu

SEQ ID NO: 1379815 - RNA, 19 nt, Human
uaggcgccugccaccacgc

SEQ ID NO: 1379816 - RNA, 21 nt, Human
uaggcgccugccaccacgccc

SEQ ID NO: 1379817 - RNA, 23 nt, Human
uaggcgccugccaccacgcccgg

SEQ ID NO: 1379818 - RNA, 23 nt, Human
uaguagaaaugggauuugccaug

SEQ ID NO: 1379819 - RNA, 24 nt, Human
uaguagggauggaguuucaccaug

SEQ ID NO: 1379820 - RNA, 21 nt, Human
uauuuuuaguagggauggagu

SEQ ID NO: 1379821 - RNA, 20 nt, Human
ucaagugauuucuccugccu

SEQ ID NO: 1379822 - RNA, 18 nt, Human
ucacugcaaccuccgccc

SEQ ID NO: 1379823 - RNA, 23 nt, Human
ucacugcaaccuccgcccccugg

SEQ ID NO: 1379824 - RNA, 23 nt, Human
ucacugcaaccuccgcccccugg

SEQ ID NO: 1379825 - RNA, 24 nt, Human
ucacugcaaccuccgcccccuggg

SEQ ID NO: 1379826 - RNA, 27 nt, Human
ucacugcaaccuccgcccccuggguuc

SEQ ID NO: 1379827 - RNA, 20 nt, Human
ucacugcaaccuccgccucc

SEQ ID NO: 1379828 - RNA, 22 nt, Human
ucacugcaaccuccgccuccgg

SEQ ID NO: 1379829 - RNA, 23 nt, Human
ucacugcaaccuccgccuccggg

SEQ ID NO: 1379830 - RNA, 25 nt, Human
ucacugcaaccuccgccuccggggu

SEQ ID NO: 1379831 - RNA, 26 nt, Human
ucacugcaaccuccgccuccgggguu

SEQ ID NO: 1379832 - RNA, 20 nt, Human
ucagccuccugaguagcugg

SEQ ID NO: 1379833 - RNA, 23 nt, Human
ucagccuccugaguggcugggac

SEQ ID NO: 1379834 - RNA, 20 nt, Human
ucaggcccaccuaauggaac

SEQ ID NO: 1379835 - RNA, 22 nt, Human
ucaggugauccgccugccucag

SEQ ID NO: 1379836 - RNA, 23 nt, Human
uccaaagugcugggauuacaggc

SEQ ID NO: 1379837 - RNA, 24 nt, Human
uccaaagugcugggauuacaggca

SEQ ID NO: 1379838 - RNA, 24 nt, Human
ucccaaaguacugggauuauaggc

SEQ ID NO: 1379839 - RNA, 24 nt, Human
ucccaaagugcugggauuacaggc

SEQ ID NO: 1379840 - RNA, 24 nt, Human
ucccaagaagcugggauuauaggc

SEQ ID NO: 1379841 - RNA, 21 nt, Human
uccgggguucaagugauuuuc

SEQ ID NO: 1379842 - RNA, 24 nt, Human
uccgggguucaagugauuuuccug

SEQ ID NO: 1379843 - RNA, 18 nt, Human
uccugaguagcugggauu

SEQ ID NO: 1379844 - RNA, 18 nt, Human
uccugaguggcugggacu

SEQ ID NO: 1379845 - RNA, 22 nt, Human
uccugccacagccucccaagaa

SEQ ID NO: 1379846 - RNA, 24 nt, Human
ucgcccaggcuggagugcaguguc

SEQ ID NO: 1379847 - RNA, 24 nt, Human
ucgcucugucgcccaggcuggagu

SEQ ID NO: 1379848 - RNA, 24 nt, Human
ucuccugccucagccuccugagua

SEQ ID NO: 1379849 - RNA, 21 nt, Human
ucucgaacuccugaccucaag

SEQ ID NO: 1379850 - RNA, 18 nt, Human
ucucgaauuccugagcug

SEQ ID NO: 1379851 - RNA, 19 nt, Human
ucucgcucugucgcccagg

SEQ ID NO: 1379852 - RNA, 23 nt, Human
ucucgcucugucgcccaggcugg

SEQ ID NO: 1379853 - RNA, 24 nt, Human
ucucgcucugucgcccaggcugga

SEQ ID NO: 1379854 - RNA, 26 nt, Human
ucucgcucugucgcccaggcuggagu

SEQ ID NO: 1379855 - RNA, 27 nt, Human
ucucgcucugucgcccaggcuggagug

SEQ ID NO: 1379856 - RNA, 23 nt, Human
ucugucaccaggcuggagugcaa

SEQ ID NO: 1379857 - RNA, 24 nt, Human
ucugucgcccaggcuggagugcag

SEQ ID NO: 1379858 - RNA, 24 nt, Human
ucugugcucuagccuuggcaacag

SEQ ID NO: 1379859 - RNA, 22 nt, Human
ucuuaaguucuuucauuacaga

SEQ ID NO: 1379860 - RNA, 24 nt, Human
ucuugcucuguugcccagacugga

SEQ ID NO: 1379861 - RNA, 25 nt, Human
ugaaaaacguaaaaacaacaacaaa

SEQ ID NO: 1379862 - RNA, 31 nt, Human
ugaaaaacguaaaaacaacaacaaaaaccaa

SEQ ID NO: 1379863 - RNA, 26 nt, Human
ugaaauaaaucaggcacaaaaagaca

SEQ ID NO: 1379864 - RNA, 18 nt, Human
ugaauagauaaacaguga

SEQ ID NO: 1379865 - RNA, 21 nt, Human
ugacccaauccauggcaacaa

SEQ ID NO: 1379866 - RNA, 18 nt, Human
ugaccucaagagaucugc

SEQ ID NO: 1379867 - RNA, 22 nt, Human
ugagacagagucuugcucuguu

SEQ ID NO: 1379868 - RNA, 22 nt, Human
ugagaccugucucugaaaaacg

SEQ ID NO: 1379869 - RNA, 21 nt, Human
ugagaucaaaacagaauaugc

SEQ ID NO: 1379870 - RNA, 21 nt, Human
ugagccaaaagucaaaaauuu

SEQ ID NO: 1379871 - RNA, 21 nt, Human
ugaggcagaacagucaaaaac

SEQ ID NO: 1379872 - RNA, 24 nt, Human
ugaucuacccaccuuggccuccca

SEQ ID NO: 1379873 - RNA, 24 nt, Human
ugauuucuccugccucagccuccu

SEQ ID NO: 1379874 - RNA, 18 nt, Human
ugcaauggugugaucgug

SEQ ID NO: 1379875 - RNA, 18 nt, Human
ugcagaagagaaauggag

SEQ ID NO: 1379876 - RNA, 22 nt, Human
ugcagugucgcaaucuuggcuc

SEQ ID NO: 1379877 - RNA, 23 nt, Human
ugcagugucgcaaucuuggcuca

SEQ ID NO: 1379878 - RNA, 21 nt, Human
ugcaucaccaugccuaccuaa

SEQ ID NO: 1379879 - RNA, 24 nt, Human
ugccacagccucccaagaagcugg

SEQ ID NO: 1379880 - RNA, 24 nt, Human
ugccauguugcccaggcuggucuc

SEQ ID NO: 1379881 - RNA, 24 nt, Human
ugccauguuggccaggcuggucuc

SEQ ID NO: 1379882 - RNA, 27 nt, Human
ugccauguuggccaggcuggucucgaa

SEQ ID NO: 1379883 - RNA, 21 nt, Human
ugcccaccucaaccuuccaaa

SEQ ID NO: 1379884 - RNA, 18 nt, Human
ugcccagacuggagucca

SEQ ID NO: 1379885 - RNA, 20 nt, Human
ugcccagacuggaguccagu

SEQ ID NO: 1379886 - RNA, 21 nt, Human
ugcccagacuggaguccagug

SEQ ID NO: 1379887 - RNA, 23 nt, Human
ugcccagacuggaguccaguggc

SEQ ID NO: 1379888 - RNA, 24 nt, Human
ugcccaggcuggucucgaauuccu

SEQ ID NO: 1379889 - RNA, 28 nt, Human
ugcccaggcuggucucgaauuccugagc

SEQ ID NO: 1379890 - RNA, 24 nt, Human
ugccucagccucccaaaguacugg

SEQ ID NO: 1379891 - RNA, 24 nt, Human
ugccucagccuccugaguagcugg

SEQ ID NO: 1379892 - RNA, 19 nt, Human
ugccuuuagucccagcuac

SEQ ID NO: 1379893 - RNA, 23 nt, Human
ugccuuuagucccagcuacucag

SEQ ID NO: 1379894 - RNA, 22 nt, Human
ugcucaaaaucuagacagaaau

SEQ ID NO: 1379895 - RNA, 19 nt, Human
ugcucuguugcccagacug

SEQ ID NO: 1379896 - RNA, 19 nt, Human
ugcugcuucaaccgccuag

SEQ ID NO: 1379897 - RNA, 24 nt, Human
ugcugggauuacaggcgugagcca

SEQ ID NO: 1379898 - RNA, 26 nt, Human
uggaacacaccaacaaaaggggaguc

SEQ ID NO: 1379899 - RNA, 19 nt, Human
uggagugcaauggugugau

SEQ ID NO: 1379900 - RNA, 21 nt, Human
uggagugcaauggugugaucg

SEQ ID NO: 1379901 - RNA, 24 nt, Human
uggagugcaauggugugaucgugg

SEQ ID NO: 1379902 - RNA, 23 nt, Human
uggagugcagugucgcaaucuug

SEQ ID NO: 1379903 - RNA, 24 nt, Human
uggagugcagugucgcaaucuugg

SEQ ID NO: 1379904 - RNA, 24 nt, Human
uggaguuucaccauguuggccagg

SEQ ID NO: 1379905 - RNA, 21 nt, Human
uggaugaauagauaaacagug

SEQ ID NO: 1379906 - RNA, 21 nt, Human
uggccaggcuggucucaaacu

SEQ ID NO: 1379907 - RNA, 24 nt, Human
uggccaggcuggucucgaacuccu

SEQ ID NO: 1379908 - RNA, 24 nt, Human
ugggacuacagacaugcaucacca

SEQ ID NO: 1379909 - RNA, 18 nt, Human
ugggauuacaggcaugag

SEQ ID NO: 1379910 - RNA, 19 nt, Human
ugggauuacaggcaugagc

SEQ ID NO: 1379911 - RNA, 21 nt, Human
ugggauuacaggcaugagcca

SEQ ID NO: 1379912 - RNA, 21 nt, Human
ugggauuacaggcaugagcca

SEQ ID NO: 1379913 - RNA, 21 nt, Human
ugggauuacaggcaugagcca

SEQ ID NO: 1379914 - RNA, 22 nt, Human
ugggauuacaggcaugagccau

SEQ ID NO: 1379915 - RNA, 23 nt, Human
ugggauuacaggcaugagccauu

SEQ ID NO: 1379916 - RNA, 24 nt, Human
ugggauuacaggcaugagccauug

SEQ ID NO: 1379917 - RNA, 27 nt, Human
ugggauuacaggcaugagccauugugc

SEQ ID NO: 1379918 - RNA, 18 nt, Human
ugggauuacaggcgugag

SEQ ID NO: 1379919 - RNA, 19 nt, Human
ugggauuacaggcgugagc

SEQ ID NO: 1379920 - RNA, 21 nt, Human
ugggauuacaggcgugagcca

SEQ ID NO: 1379921 - RNA, 25 nt, Human
ugggauuacaggcgugagccaaaag

SEQ ID NO: 1379922 - RNA, 26 nt, Human
ugggauuacaggcgugagccaaaagu

SEQ ID NO: 1379923 - RNA, 22 nt, Human
ugggauuacaugcgcacaccac

SEQ ID NO: 1379924 - RNA, 24 nt, Human
ugggauuacaugcgcacaccacca

SEQ ID NO: 1379925 - RNA, 18 nt, Human
ugggauuauaggcgagag

SEQ ID NO: 1379926 - RNA, 19 nt, Human
ugggauuauaggcgagagc

SEQ ID NO: 1379927 - RNA, 21 nt, Human
ugggauuauaggcgagagcca

SEQ ID NO: 1379928 - RNA, 22 nt, Human
ugggauuauaggcgagagccac

SEQ ID NO: 1379929 - RNA, 23 nt, Human
ugggauuauaggcgagagccacc

SEQ ID NO: 1379930 - RNA, 24 nt, Human
ugggauuauaggcgagagccacca

SEQ ID NO: 1379931 - RNA, 21 nt, Human
ugggauuauaggcgccugcca

SEQ ID NO: 1379932 - RNA, 22 nt, Human
ugggauuauaggcgccugccac

SEQ ID NO: 1379933 - RNA, 24 nt, Human
ugggauuauaggcgccugccacca

SEQ ID NO: 1379934 - RNA, 23 nt, Human
ugggauuugccauguuggccagg

SEQ ID NO: 1379935 - RNA, 24 nt, Human
ugggguuuugccauguugcccagg

SEQ ID NO: 1379936 - RNA, 18 nt, Human
uggguucaagugauuucu

SEQ ID NO: 1379937 - RNA, 24 nt, Human
uggguucaagugauuucuccugcc

SEQ ID NO: 1379938 - RNA, 24 nt, Human
uguagagaugggguuuugccaugu

SEQ ID NO: 1379939 - RNA, 23 nt, Human
ugugaucaaguguucaucaaugg

SEQ ID NO: 1379940 - RNA, 23 nt, Human
uuaaacaucuuuuaucuuuuuuu

SEQ ID NO: 1379941 - RNA, 21 nt, Human
uuagccuuaaaaaggauagaa

SEQ ID NO: 1379942 - RNA, 18 nt, Human
uuaguagaaaugggauuu

SEQ ID NO: 1379943 - RNA, 23 nt, Human
uuaguagaaaugggauuugccau

SEQ ID NO: 1379944 - RNA, 18 nt, Human
uuaguagggauggaguuu

SEQ ID NO: 1379945 - RNA, 24 nt, Human
uuaguagggauggaguuucaccau

SEQ ID NO: 1379946 - RNA, 22 nt, Human
uucaagugauuucuccugccuc

SEQ ID NO: 1379947 - RNA, 24 nt, Human
uucaagugauuucuccugccucag

SEQ ID NO: 1379948 - RNA, 19 nt, Human
uucaagugauuuuccugcc

SEQ ID NO: 1379949 - RNA, 24 nt, Human
uucagccuccugaguggcugggac

SEQ ID NO: 1379950 - RNA, 24 nt, Human
uugccauguuggccaggcuggucu

SEQ ID NO: 1379951 - RNA, 18 nt, Human
uuggccucccaaagugcu

SEQ ID NO: 1379952 - RNA, 24 nt, Human
uuguagagaugggguuuugccaug

SEQ ID NO: 1379953 - RNA, 24 nt, Human
uuucaccauguuggccaggcuggu

SEQ ID NO: 1379954 - RNA, 24 nt, Human
uuuguagagaugggguuuugccau

SEQ ID NO: 1379955 - RNA, 22 nt, Human
uuuugccauguugcccaggcug

SEQ ID NO: 1379956 - RNA, 23 nt, Human
uuuugccauguugcccaggcugg

SEQ ID NO: 1379957 - RNA, 21 nt, Human
uuuuuaguagaaaugggauuu

SEQ ID NO: 1379958 - RNA, 24 nt, Human
uuuuuaguagggauggaguuucac

SEQ ID NO: 1379959 - RNA, 18 nt, Human
uuuuuguauuuuuaguag

SEQ ID NO: 1379960 - RNA, 20 nt, Human
uuuuuguauuuuuuguagag

SEQ ID NO: 1379961 - RNA, 23 nt, Human
uuuuuguauuuuuuguagagaug

SEQ ID NO: 1379962 - RNA, 24 nt, Human
uuuuuuguagagaugggguuuugc

SEQ ID NO: 1379963 - RNA, 20 nt, Human
uuuuuuuuuuugagacagag

SEQ ID NO: 1379964 - RNA, 23 nt, Human
aaacuucugaccucaggcaaucc

SEQ ID NO: 1379965 - RNA, 24 nt, Human
aaagugcugggauuacaggcauga

SEQ ID NO: 1379966 - RNA, 21 nt, Human
aaaucucccuuaucucuaccu

SEQ ID NO: 1379967 - RNA, 18 nt, Human
aaaucuccuucagaggcc

SEQ ID NO: 1379968 - RNA, 19 nt, Human
aacauggcaaaacccaucu

SEQ ID NO: 1379969 - RNA, 21 nt, Human
aaccaaagaguaguaagacag

SEQ ID NO: 1379970 - RNA, 20 nt, Human
aaccuccuucaggaagcuaa

SEQ ID NO: 1379971 - RNA, 23 nt, Human
aagauuaaaaguuacacaaaucu

SEQ ID NO: 1379972 - RNA, 26 nt, Human
aagcacuaggauuacaguugugagcc

SEQ ID NO: 1379973 - RNA, 22 nt, Human
aaguagcugagauuacaggcau

SEQ ID NO: 1379974 - RNA, 25 nt, Human
aaguagcugagauuacaggcauucg

SEQ ID NO: 1379975 - RNA, 19 nt, Human
aagugcugggauuacaggc

SEQ ID NO: 1379976 - RNA, 21 nt, Human
aagugcugggauuacaggcau

SEQ ID NO: 1379977 - RNA, 26 nt, Human
aagugcugggauuacaggcaugagcc

SEQ ID NO: 1379978 - RNA, 24 nt, Human
acagagcaagaccuugucucaaaa

SEQ ID NO: 1379979 - RNA, 24 nt, Human
acagagggagacuccaucucaaaa

SEQ ID NO: 1379980 - RNA, 21 nt, Human
acaggcauucgccaccaugcc

SEQ ID NO: 1379981 - RNA, 18 nt, Human
accaacaagaggucuugc

SEQ ID NO: 1379982 - RNA, 18 nt, Human
accacgccuggcuaauuu

SEQ ID NO: 1379983 - RNA, 18 nt, Human
accauguuggccaggcug

SEQ ID NO: 1379984 - RNA, 24 nt, Human
accggaggucaggaguucaagacc

SEQ ID NO: 1379985 - RNA, 21 nt, Human
accuguaguaacagcacuuug

SEQ ID NO: 1379986 - RNA, 28 nt, Human
accuugucucaaaaaaaaaaaaaaaaaa

SEQ ID NO: 1379987 - RNA, 25 nt, Human
acucugucucccaggcuggaaagca

SEQ ID NO: 1379988 - RNA, 26 nt, Human
acugcacucuagaaccugggcaacag

SEQ ID NO: 1379989 - RNA, 19 nt, Human
acugcagccuugaccuccu

SEQ ID NO: 1379990 - RNA, 18 nt, Human
acuuguuuuccaggcugg

SEQ ID NO: 1379991 - RNA, 21 nt, Human
acuuguuuuccaggcuggagu

SEQ ID NO: 1379992 - RNA, 24 nt, Human
acuuugggaggcagaggugggcag

SEQ ID NO: 1379993 - RNA, 24 nt, Human
agagauucuccugucucagccucc

SEQ ID NO: 1379994 - RNA, 24 nt, Human
agcacuuugggaggcagagguggg

SEQ ID NO: 1379995 - RNA, 24 nt, Human
agcacuuugggaggccgagguggg

SEQ ID NO: 1379996 - RNA, 19 nt, Human
agccaggugugguggugau

SEQ ID NO: 1379997 - RNA, 19 nt, Human
aggaggaugagagagcccu

SEQ ID NO: 1379998 - RNA, 24 nt, Human
aggcaauccgcccguguuggccuc

SEQ ID NO: 1379999 - RNA, 24 nt, Human
aggcacgguggcucacaccuauaa

SEQ ID NO: 1380000 - RNA, 21 nt, Human
aggcagaggugggcagaucac

SEQ ID NO: 1380001 - RNA, 21 nt, Human
aggccgaggugggagaaucac

SEQ ID NO: 1380002 - RNA, 24 nt, Human
aggccgaggugggagaaucacuug

SEQ ID NO: 1380003 - RNA, 20 nt, Human
aggcggagguugcagugagc

SEQ ID NO: 1380004 - RNA, 24 nt, Human
aggcggagguugcagugagcugag

SEQ ID NO: 1380005 - RNA, 18 nt, Human
aggugggagaaucacuug

SEQ ID NO: 1380006 - RNA, 23 nt, Human
aggugggagaaucacuuggaccc

SEQ ID NO: 1380007 - RNA, 22 nt, Human
aggugggcagaucaccggaggu

SEQ ID NO: 1380008 - RNA, 24 nt, Human
aggugugguggugaucgccuguaa

SEQ ID NO: 1380009 - RNA, 21 nt, Human
agugcaauggcgcgauuucag

SEQ ID NO: 1380010 - RNA, 18 nt, Human
agugcugggauuacaggc

SEQ ID NO: 1380011 - RNA, 22 nt, Human
auaaaucuccuucagaggccag

SEQ ID NO: 1380012 - RNA, 25 nt, Human
auaauaauaacuuccuaaguaugcc

SEQ ID NO: 1380013 - RNA, 25 nt, Human
aucaugcaccacugcacucuagaac

SEQ ID NO: 1380014 - RNA, 18 nt, Human
auccucccgccucagccu

SEQ ID NO: 1380015 - RNA, 22 nt, Human
augggguuucaccauguuggcc

SEQ ID NO: 1380016 - RNA, 24 nt, Human
caaagcacuaggauuacaguugug

SEQ ID NO: 1380017 - RNA, 24 nt, Human
caaagugcugggauuacaggcaug

SEQ ID NO: 1380018 - RNA, 20 nt, Human
caacaaacuuauuuuugauu

SEQ ID NO: 1380019 - RNA, 22 nt, Human
caagagauucuccugucucagc

SEQ ID NO: 1380020 - RNA, 26 nt, Human
cacaccuauaaucccccagcacuuug

SEQ ID NO: 1380021 - RNA, 26 nt, Human
caccacugcacucuagaaccugggca

SEQ ID NO: 1380022 - RNA, 24 nt, Human
caccaugcccagcuaauuuuugua

SEQ ID NO: 1380023 - RNA, 21 nt, Human
caccauguuggccaggcuggu

SEQ ID NO: 1380024 - RNA, 24 nt, Human
caccauguuggccaggcuggucuc

SEQ ID NO: 1380025 - RNA, 23 nt, Human
caccggaggucaggaguucaaga

SEQ ID NO: 1380026 - RNA, 25 nt, Human
caccuauaaucccccagcacuuugg

SEQ ID NO: 1380027 - RNA, 24 nt, Human
cacucugucucccaggcuggaaag

SEQ ID NO: 1380028 - RNA, 21 nt, Human
cacugcaaccucugccucccg

SEQ ID NO: 1380029 - RNA, 23 nt, Human
cacugcaaccucugccucccggg

SEQ ID NO: 1380030 - RNA, 21 nt, Human
cacugcacucuagaaccuggg

SEQ ID NO: 1380031 - RNA, 24 nt, Human
cacugcacucuagaaccugggcaa

SEQ ID NO: 1380032 - RNA, 25 nt, Human
cacugcacucuagaaccugggcaac

SEQ ID NO: 1380033 - RNA, 26 nt, Human
cacugcacucuagaaccugggcaaca

SEQ ID NO: 1380034 - RNA, 19 nt, Human
cacugcagccuugaccucc

SEQ ID NO: 1380035 - RNA, 18 nt, Human
cacuuguuuuccaggcug

SEQ ID NO: 1380036 - RNA, 27 nt, Human
cagaggugggcagaucaccggagguca

SEQ ID NO: 1380037 - RNA, 24 nt, Human
cagaucaccggaggucaggaguuc

SEQ ID NO: 1380038 - RNA, 24 nt, Human
cagcacuuugggaggcagaggugg

SEQ ID NO: 1380039 - RNA, 24 nt, Human
cagcacuuugggaggccgaggugg

SEQ ID NO: 1380040 - RNA, 22 nt, Human
cagcagaauugcuucagcccag

SEQ ID NO: 1380041 - RNA, 21 nt, Human
cagccuugaccuccuaggcuc

SEQ ID NO: 1380042 - RNA, 23 nt, Human
cagccuugaccuccuaggcucaa

SEQ ID NO: 1380043 - RNA, 24 nt, Human
cagccuugaccuccuaggcucaaa

SEQ ID NO: 1380044 - RNA, 24 nt, Human
cauguuggccaggcuggucucaaa

SEQ ID NO: 1380045 - RNA, 23 nt, Human
ccaaagugcugggauuacaggca

SEQ ID NO: 1380046 - RNA, 24 nt, Human
ccaaagugcugggauuacaggcau

SEQ ID NO: 1380047 - RNA, 23 nt, Human
ccaaguagcugagauuacaggca

SEQ ID NO: 1380048 - RNA, 24 nt, Human
ccaaguagcugagauuacaggcau

SEQ ID NO: 1380049 - RNA, 22 nt, Human
ccacugcacucuagaaccuggg

SEQ ID NO: 1380050 - RNA, 22 nt, Human
ccacugcacucuagaaccuggg

SEQ ID NO: 1380051 - RNA, 26 nt, Human
ccacugcacucuagaaccugggcaac

SEQ ID NO: 1380052 - RNA, 22 nt, Human
ccagaccaacaagaggucuugc

SEQ ID NO: 1380053 - RNA, 22 nt, Human
ccaggaggcggagguugcagug

SEQ ID NO: 1380054 - RNA, 18 nt, Human
ccaggcuggagugcaaug

SEQ ID NO: 1380055 - RNA, 24 nt, Human
cccaaagugcugggauuacaggca

SEQ ID NO: 1380056 - RNA, 19 nt, Human
cccaaguagcugagauuac

SEQ ID NO: 1380057 - RNA, 24 nt, Human
cccaaguagcugagauuacaggca

SEQ ID NO: 1380058 - RNA, 21 nt, Human
cccccacccagucccagggac

SEQ ID NO: 1380059 - RNA, 22 nt, Human
cccccacccagucccagggacu

SEQ ID NO: 1380060 - RNA, 20 nt, Human
cccccagcacuuugggaggc

SEQ ID NO: 1380061 - RNA, 23 nt, Human
cccggguucaagagauucuccug

SEQ ID NO: 1380062 - RNA, 22 nt, Human
cccguguuggccucccaaagug

SEQ ID NO: 1380063 - RNA, 23 nt, Human
ccgccucagccuucugaguagcu

SEQ ID NO: 1380064 - RNA, 22 nt, Human
ccuaggcucaaacaauccuccc

SEQ ID NO: 1380065 - RNA, 20 nt, Human
ccucccaaagcacuaggauu

SEQ ID NO: 1380066 - RNA, 24 nt, Human
ccucccgccucagccuucugagua

SEQ ID NO: 1380067 - RNA, 24 nt, Human
ccucccggguucaagagauucucc

SEQ ID NO: 1380068 - RNA, 22 nt, Human
ccuccugccucgaccucccaaa

SEQ ID NO: 1380069 - RNA, 24 nt, Human
ccuccugccucgaccucccaaagc

SEQ ID NO: 1380070 - RNA, 21 nt, Human
ccuggucucaagggagccucc

SEQ ID NO: 1380071 - RNA, 22 nt, Human
ccuguaaccccagcuccuuggg

SEQ ID NO: 1380072 - RNA, 19 nt, Human
ccuugaccuccuaggcuca

SEQ ID NO: 1380073 - RNA, 24 nt, Human
ccuugucucaaaaaaaaaaaaaaa

SEQ ID NO: 1380074 - RNA, 22 nt, Human
cgaggugggagaaucacuugga

SEQ ID NO: 1380075 - RNA, 20 nt, Human
cgccgccccccacccagucc

SEQ ID NO: 1380076 - RNA, 20 nt, Human
cgccucagccuucugaguag

SEQ ID NO: 1380077 - RNA, 23 nt, Human
cgccucagccuucugaguagcuu

SEQ ID NO: 1380078 - RNA, 21 nt, Human
cgccuguaaccccagcuccuu

SEQ ID NO: 1380079 - RNA, 23 nt, Human
cgccuguaaccccagcuccuugg

SEQ ID NO: 1380080 - RNA, 21 nt, Human
cuauacugaaaaaugucagaa

SEQ ID NO: 1380081 - RNA, 18 nt, Human
cucaaaaaaaaaaaaaaa

SEQ ID NO: 1380082 - RNA, 23 nt, Human
cucaaaaaaaaaaaaaaaaaaaa

SEQ ID NO: 1380083 - RNA, 26 nt, Human
cucaaaaaaaaaaaaaaaaaaaaaaa

SEQ ID NO: 1380084 - RNA, 24 nt, Human
cucaaacaauccucccgccucagc

SEQ ID NO: 1380085 - RNA, 24 nt, Human
cucacaccuauaaucccccagcac

SEQ ID NO: 1380086 - RNA, 24 nt, Human
cucacugcaaccucugccucccgg

SEQ ID NO: 1380087 - RNA, 21 nt, Human
cucacugcagccuugaccucc

SEQ ID NO: 1380088 - RNA, 23 nt, Human
cucauuagagauuugaagccaga

SEQ ID NO: 1380089 - RNA, 21 nt, Human
cucccaaguagcugagauuac

SEQ ID NO: 1380090 - RNA, 21 nt, Human
cuccuugggaggcugagacag

SEQ ID NO: 1380091 - RNA, 21 nt, Human
cucugucucccaggcuggaaa

SEQ ID NO: 1380092 - RNA, 20 nt, Human
cugaaaaaugucagaaugua

SEQ ID NO: 1380093 - RNA, 21 nt, Human
cugaccucaggcaauccgccc

SEQ ID NO: 1380094 - RNA, 19 nt, Human
cugcaaccucugccucccg

SEQ ID NO: 1380095 - RNA, 23 nt, Human
cugcaaccucugccucccggguu

SEQ ID NO: 1380096 - RNA, 24 nt, Human
cugcaaccucugccucccggguuc

SEQ ID NO: 1380097 - RNA, 22 nt, Human
cugcagccuugaccuccuaggc

SEQ ID NO: 1380098 - RNA, 23 nt, Human
cugcagccuugaccuccuaggcu

SEQ ID NO: 1380099 - RNA, 21 nt, Human
cuggucucaaacuccuggucu

SEQ ID NO: 1380100 - RNA, 23 nt, Human
cugucucagccucccaaguagcu

SEQ ID NO: 1380101 - RNA, 23 nt, Human
cuucugaccucaggcaauccgcc

SEQ ID NO: 1380102 - RNA, 26 nt, Human
cuucugaccucaggcaauccgcccgu

SEQ ID NO: 1380103 - RNA, 22 nt, Human
cuuugcaguuccgccgcccccc

SEQ ID NO: 1380104 - RNA, 24 nt, Human
cuuuuaguagaaaugggguuucac

SEQ ID NO: 1380105 - RNA, 18 nt, Human
gaacacuaaucggauugg

SEQ ID NO: 1380106 - RNA, 20 nt, Human
gagacagggucucacucugu

SEQ ID NO: 1380107 - RNA, 21 nt, Human
gagccuccugccucgaccucc

SEQ ID NO: 1380108 - RNA, 21 nt, Human
gaggcggagguugcagugagc

SEQ ID NO: 1380109 - RNA, 23 nt, Human
gagguugcagugagcugagaucg

SEQ ID NO: 1380110 - RNA, 21 nt, Human
gaucaaugaagauuaaaaguu

SEQ ID NO: 1380111 - RNA, 23 nt, Human
gaucaccggaggucaggaguuca

SEQ ID NO: 1380112 - RNA, 24 nt, Human
gaucaccggaggucaggaguucaa

SEQ ID NO: 1380113 - RNA, 20 nt, Human
gauuaagccaaaucucccuu

SEQ ID NO: 1380114 - RNA, 18 nt, Human
gauuacaggcaugagcca

SEQ ID NO: 1380115 - RNA, 22 nt, Human
gauuacaggcaugagccacugc

SEQ ID NO: 1380116 - RNA, 23 nt, Human
gauuacaggcaugagccacugca

SEQ ID NO: 1380117 - RNA, 22 nt, Human
gauuacaggcauucgccaccau

SEQ ID NO: 1380118 - RNA, 18 nt, Human
gauuacaguugugagcca

SEQ ID NO: 1380119 - RNA, 21 nt, Human
gauuacaguugugagccacca

SEQ ID NO: 1380120 - RNA, 22 nt, Human
gcaguuccgccgccccccaccc

SEQ ID NO: 1380121 - RNA, 23 nt, Human
gccacugcacccggccaacaaac

SEQ ID NO: 1380122 - RNA, 18 nt, Human
gccucgaccucccaaagc

SEQ ID NO: 1380123 - RNA, 23 nt, Human
gccucgaccucccaaagcacuag

SEQ ID NO: 1380124 - RNA, 21 nt, Human
gcucacugcagccuugaccuc

SEQ ID NO: 1380125 - RNA, 19 nt, Human
gcuggagugcaauggcgcg

SEQ ID NO: 1380126 - RNA, 22 nt, Human
ggagguugcagugagcugagau

SEQ ID NO: 1380127 - RNA, 24 nt, Human
ggagguugcagugagcugagaucg

SEQ ID NO: 1380128 - RNA, 22 nt, Human
ggauuacaggcaugagccacug

SEQ ID NO: 1380129 - RNA, 22 nt, Human
ggauuacaguugugagccacca

SEQ ID NO: 1380130 - RNA, 24 nt, Human
ggcuggucucaaacuccuggucuc

SEQ ID NO: 1380131 - RNA, 24 nt, Human
ggcuggucucaaacuucugaccuc

SEQ ID NO: 1380132 - RNA, 26 nt, Human
gggcagaucaccggaggucaggaguu

SEQ ID NO: 1380133 - RNA, 24 nt, Human
gggggucuuguuacguugcccagg

SEQ ID NO: 1380134 - RNA, 22 nt, Human
gggguuucaccauguuggccag

SEQ ID NO: 1380135 - RNA, 22 nt, Human
gggucuuguuacguugcccagg

SEQ ID NO: 1380136 - RNA, 18 nt, Human
ggguuucaccauguuggc

SEQ ID NO: 1380137 - RNA, 19 nt, Human
ggucucaaacuucugaccu

SEQ ID NO: 1380138 - RNA, 22 nt, Human
guugcagugagcugagaucguc

SEQ ID NO: 1380139 - RNA, 20 nt, Human
uaaaaauacaaaauuuagcc

SEQ ID NO: 1380140 - RNA, 21 nt, Human
uaaaaauacaaaauuuagcca

SEQ ID NO: 1380141 - RNA, 19 nt, Human
uaauaccauacguuaauau

SEQ ID NO: 1380142 - RNA, 22 nt, Human
uaauuuuuguacuuuuaguaga

SEQ ID NO: 1380143 - RNA, 22 nt, Human
uacaggcacgugcuaccacgcc

SEQ ID NO: 1380144 - RNA, 23 nt, Human
uacaggcaugagccacugcaccc

SEQ ID NO: 1380145 - RNA, 24 nt, Human
uacaggcauucgccaccaugccca

SEQ ID NO: 1380146 - RNA, 24 nt, Human
uacaguugugagccaccacaucca

SEQ ID NO: 1380147 - RNA, 24 nt, Human
uaccacgccuggcuaauuuuuaau

SEQ ID NO: 1380148 - RNA, 23 nt, Human
uacguugcccaggcuggucucaa

SEQ ID NO: 1380149 - RNA, 24 nt, Human
uacguugcccaggcuggucucaaa

SEQ ID NO: 1380150 - RNA, 22 nt, Human
uacucuauucacuugguauuua

SEQ ID NO: 1380151 - RNA, 22 nt, Human
uagaaaugggguuucaccaugu

SEQ ID NO: 1380152 - RNA, 20 nt, Human
uagccaaauauuuuuaguua

SEQ ID NO: 1380153 - RNA, 22 nt, Human
uaggauuacaguugugagccac

SEQ ID NO: 1380154 - RNA, 24 nt, Human
uaggauuacaguugugagccacca

SEQ ID NO: 1380155 - RNA, 26 nt, Human
uaguaagacagugaaauuuaggagga

SEQ ID NO: 1380156 - RNA, 24 nt, Human
uaguagaaaugggguuucaccaug

SEQ ID NO: 1380157 - RNA, 26 nt, Human
uaguagaaaugggguuucaccauguu

SEQ ID NO: 1380158 - RNA, 23 nt, Human
ucaaaaaaaaaaaaaaaaaaaaa

SEQ ID NO: 1380159 - RNA, 23 nt, Human
ucacacuuguuuuccaggcugga

SEQ ID NO: 1380160 - RNA, 23 nt, Human
ucaccggaggucaggaguucaag

SEQ ID NO: 1380161 - RNA, 24 nt, Human
ucacugcaaccucugccucccggg

SEQ ID NO: 1380162 - RNA, 25 nt, Human
ucacugcaaccucugccucccgggu

SEQ ID NO: 1380163 - RNA, 19 nt, Human
ucacugcagccuugaccuc

SEQ ID NO: 1380164 - RNA, 23 nt, Human
ucacugcagccuugaccuccuag

SEQ ID NO: 1380165 - RNA, 24 nt, Human
ucacugcagccuugaccuccuagg

SEQ ID NO: 1380166 - RNA, 21 nt, Human
ucagccucccaaguagcugag

SEQ ID NO: 1380167 - RNA, 23 nt, Human
ucagccuucugaguagcuugggc

SEQ ID NO: 1380168 - RNA, 18 nt, Human
ucaggaagcuaagccaug

SEQ ID NO: 1380169 - RNA, 18 nt, Human
uccagcuuggugacagag

SEQ ID NO: 1380170 - RNA, 19 nt, Human
uccagcuuggugacagagg

SEQ ID NO: 1380171 - RNA, 24 nt, Human
ucccaaagugcugggauuacaggc

SEQ ID NO: 1380172 - RNA, 24 nt, Human
ucccaaguagcugagauuacaggc

SEQ ID NO: 1380173 - RNA, 21 nt, Human
ucccggguucaagagauucuc

SEQ ID NO: 1380174 - RNA, 24 nt, Human
ucccggguucaagagauucuccug

SEQ ID NO: 1380175 - RNA, 19 nt, Human
uccuucaggaagcuaagcc

SEQ ID NO: 1380176 - RNA, 19 nt, Human
ucucaaaaaaaaaaaaaaa

SEQ ID NO: 1380177 - RNA, 23 nt, Human
ucucacucugucucccaggcugg

SEQ ID NO: 1380178 - RNA, 24 nt, Human
ucucacucugucucccaggcugga

SEQ ID NO: 1380179 - RNA, 26 nt, Human
ucuccugucucagccucccaaguagc

SEQ ID NO: 1380180 - RNA, 22 nt, Human
ucucuacuaaaaauacaaaauu

SEQ ID NO: 1380181 - RNA, 24 nt, Human
ucugaguagcuugggcuacaggca

SEQ ID NO: 1380182 - RNA, 20 nt, Human
ucuuacacacucuaaaagac

SEQ ID NO: 1380183 - RNA, 23 nt, Human
ucuuguuacguugcccaggcugg

SEQ ID NO: 1380184 - RNA, 24 nt, Human
ucuuguuacguugcccaggcuggu

SEQ ID NO: 1380185 - RNA, 21 nt, Human
ugaccucaggcaauccgcccg

SEQ ID NO: 1380186 - RNA, 24 nt, Human
ugaccuccuaggcucaaacaaucc

SEQ ID NO: 1380187 - RNA, 25 nt, Human
ugaccuccuaggcucaaacaauccu

SEQ ID NO: 1380188 - RNA, 20 nt, Human
ugagacagggucucacucug

SEQ ID NO: 1380189 - RNA, 22 nt, Human
ugagacagggucucacucuguc

SEQ ID NO: 1380190 - RNA, 19 nt, Human
ugagauuacaggcauucgc

SEQ ID NO: 1380191 - RNA, 21 nt, Human
ugagauuacaggcauucgcca

SEQ ID NO: 1380192 - RNA, 22 nt, Human
ugagauuacaggcauucgccac

SEQ ID NO: 1380193 - RNA, 24 nt, Human
ugagauuacaggcauucgccacca

SEQ ID NO: 1380194 - RNA, 24 nt, Human
ugcaaugagccgugaucaugcacc

SEQ ID NO: 1380195 - RNA, 24 nt, Human
ugcccaggcuggucucaaacuccu

SEQ ID NO: 1380196 - RNA, 23 nt, Human
ugccucgaccucccaaagcacua

SEQ ID NO: 1380197 - RNA, 24 nt, Human
ugccucgaccucccaaagcacuag

SEQ ID NO: 1380198 - RNA, 24 nt, Human
uggaaagcaauggcacaauauugg

SEQ ID NO: 1380199 - RNA, 23 nt, Human
uggagugcaauggcgcgauuuca

SEQ ID NO: 1380200 - RNA, 24 nt, Human
uggagugcaauggcgcgauuucag

SEQ ID NO: 1380201 - RNA, 23 nt, Human
uggcacaauauuggcucacugca

SEQ ID NO: 1380202 - RNA, 24 nt, Human
uggccaggcuggucucaaacuucu

SEQ ID NO: 1380203 - RNA, 24 nt, Human
uggcgcgauuucagcucacugcaa

SEQ ID NO: 1380204 - RNA, 20 nt, Human
uggcucacaccuauaauccc

SEQ ID NO: 1380205 - RNA, 24 nt, Human
uggcucacugcagccuugaccucc

SEQ ID NO: 1380206 - RNA, 18 nt, Human
ugggaggcagaggugggc

SEQ ID NO: 1380207 - RNA, 19 nt, Human
ugggaggcagaggugggca

SEQ ID NO: 1380208 - RNA, 20 nt, Human
ugggaggcagaggugggcag

SEQ ID NO: 1380209 - RNA, 24 nt, Human
ugggaggcagaggugggcagauca

SEQ ID NO: 1380210 - RNA, 19 nt, Human
ugggaggccgaggugggag

SEQ ID NO: 1380211 - RNA, 24 nt, Human
ugggaggccgaggugggagaauca

SEQ ID NO: 1380212 - RNA, 18 nt, Human
ugggaggcugagacagca

SEQ ID NO: 1380213 - RNA, 20 nt, Human
ugggaggcugagacagcaga

SEQ ID NO: 1380214 - RNA, 18 nt, Human
ugggauuacaggcaugag

SEQ ID NO: 1380215 - RNA, 19 nt, Human
ugggauuacaggcaugagc

SEQ ID NO: 1380216 - RNA, 21 nt, Human
ugggauuacaggcaugagcca

SEQ ID NO: 1380217 - RNA, 22 nt, Human
ugggauuacaggcaugagccac

SEQ ID NO: 1380218 - RNA, 22 nt, Human
ugggauuacaggcaugagccac

SEQ ID NO: 1380219 - RNA, 24 nt, Human
ugggauuacaggcaugagccacug

SEQ ID NO: 1380220 - RNA, 24 nt, Human
ugggauuacaggcaugagccacug

SEQ ID NO: 1380221 - RNA, 26 nt, Human
ugggauuacaggcaugagccacugca

SEQ ID NO: 1380222 - RNA, 24 nt, Human
ugggcagaucaccggaggucagga

SEQ ID NO: 1380223 - RNA, 23 nt, Human
ugggcuacaggcacgugcuacca

SEQ ID NO: 1380224 - RNA, 24 nt, Human
ugggguuucaccauguuggccagg

SEQ ID NO: 1380225 - RNA, 24 nt, Human
ugucucagccucccaaguagcuga

SEQ ID NO: 1380226 - RNA, 21 nt, Human
uguguacaacuaugaagauca

SEQ ID NO: 1380227 - RNA, 24 nt, Human
uguuacguugcccaggcuggucuc

SEQ ID NO: 1380228 - RNA, 27 nt, Human
uguuacguugcccaggcuggucucaaa

SEQ ID NO: 1380229 - RNA, 26 nt, Human
uguucuacuuauauaaaucuccuuca

SEQ ID NO: 1380230 - RNA, 18 nt, Human
uguucuuguucuugguca

SEQ ID NO: 1380231 - RNA, 18 nt, Human
uuaguagaaaugggguuu

SEQ ID NO: 1380232 - RNA, 22 nt, Human
uuaguagaaaugggguuucacc

SEQ ID NO: 1380233 - RNA, 24 nt, Human
uuaguagaaaugggguuucaccau

SEQ ID NO: 1380234 - RNA, 24 nt, Human
uucacacuuguuuuccaggcugga

SEQ ID NO: 1380235 - RNA, 24 nt, Human
uucagcccaggaggcggagguugc

SEQ ID NO: 1380236 - RNA, 23 nt, Human
uuccaggcuggagugcaauggcg

SEQ ID NO: 1380237 - RNA, 24 nt, Human
uucugaguagcuugggcuacaggc

SEQ ID NO: 1380238 - RNA, 21 nt, Human
uucuuguucuuggucauuuca

SEQ ID NO: 1380239 - RNA, 21 nt, Human
uugaaaaauacuuugcaguuc

SEQ ID NO: 1380240 - RNA, 20 nt, Human
uugcagugagcugagaucgu

SEQ ID NO: 1380241 - RNA, 22 nt, Human
uugcagugagcugagaucgucc

SEQ ID NO: 1380242 - RNA, 21 nt, Human
uugcucuuucccucaauugcc

SEQ ID NO: 1380243 - RNA, 24 nt, Human
uugcuucagcccaggaggcggagg

SEQ ID NO: 1380244 - RNA, 19 nt, Human
uugggaggcagaggugggc

SEQ ID NO: 1380245 - RNA, 25 nt, Human
uugggaggccgaggugggagaauca

SEQ ID NO: 1380246 - RNA, 23 nt, Human
uugggaggcugagacagcagaau

SEQ ID NO: 1380247 - RNA, 20 nt, Human
uugugagccaccacauccag

SEQ ID NO: 1380248 - RNA, 23 nt, Human
uuguuuuccaggcuggagugcaa

SEQ ID NO: 1380249 - RNA, 21 nt, Human
uuuacauugguauuuuggcca

SEQ ID NO: 1380250 - RNA, 18 nt, Human
uuuagccagguguggugg

SEQ ID NO: 1380251 - RNA, 23 nt, Human
uuucacacuuguuuuccaggcug

SEQ ID NO: 1380252 - RNA, 24 nt, Human
uuucaccauguuggccaggcuggu

SEQ ID NO: 1380253 - RNA, 24 nt, Human
uuuggccaggcacgguggcucaca

SEQ ID NO: 1380254 - RNA, 25 nt, Human
uuuguuguuguugagacagggucuc

SEQ ID NO: 1380255 - RNA, 22 nt, Human
uuuuuucuacacuauauuugag

SEQ ID NO: 1380256 - RNA, 21 nt, Human
aaaaauaauugggggacuggu

SEQ ID NO: 1380257 - RNA, 20 nt, Human
aaagaugcaucccuucccag

SEQ ID NO: 1380258 - RNA, 24 nt, Human
aaagugcugggauuacaggcguga

SEQ ID NO: 1380259 - RNA, 21 nt, Human
aacaaagcaagaccucaucuc

SEQ ID NO: 1380260 - RNA, 24 nt, Human
aagugauccgcccccguuggccuc

SEQ ID NO: 1380261 - RNA, 19 nt, Human
aagugcugggauuacaggc

SEQ ID NO: 1380262 - RNA, 19 nt, Human
aagugcugggauuacaggc

SEQ ID NO: 1380263 - RNA, 26 nt, Human
aagugcugggauuacaggcgugagcc

SEQ ID NO: 1380264 - RNA, 18 nt, Human
aagugggaggaucgcuug

SEQ ID NO: 1380265 - RNA, 21 nt, Human
aauugggggacuggugcggug

SEQ ID NO: 1380266 - RNA, 18 nt, Human
acaaagcaagaccucauc

SEQ ID NO: 1380267 - RNA, 18 nt, Human
acaggguuucaccauguu

SEQ ID NO: 1380268 - RNA, 23 nt, Human
acaggguuucaccauguuggcca

SEQ ID NO: 1380269 - RNA, 24 nt, Human
acaggguuucaccauguuggccag

SEQ ID NO: 1380270 - RNA, 24 nt, Human
accauguuggccaggcuggucucg

SEQ ID NO: 1380271 - RNA, 24 nt, Human
agcacuuuggaaggccaaaguggg

SEQ ID NO: 1380272 - RNA, 18 nt, Human
agccacugugcccagccc

SEQ ID NO: 1380273 - RNA, 22 nt, Human
agcuguugccccggguaacggu

SEQ ID NO: 1380274 - RNA, 24 nt, Human
aggccaaagugggaggaucgcuug

SEQ ID NO: 1380275 - RNA, 25 nt, Human
aggcuggggugcaguggcacgaucu

SEQ ID NO: 1380276 - RNA, 18 nt, Human
aguagcugggauuacagg

SEQ ID NO: 1380277 - RNA, 19 nt, Human
aguagcugggauuacaggc

SEQ ID NO: 1380278 - RNA, 20 nt, Human
aguagcugggauuacaggcc

SEQ ID NO: 1380279 - RNA, 18 nt, Human
agugcugggauuacaggc

SEQ ID NO: 1380280 - RNA, 30 nt, Human
aucuggaaucccagcacuuuggaaggccaa

SEQ ID NO: 1380281 - RNA, 23 nt, Human
augcaaauccugguauaaaggau

SEQ ID NO: 1380282 - RNA, 21 nt, Human
augccuuuccuucauacaucc

SEQ ID NO: 1380283 - RNA, 21 nt, Human
auuacaggcgcaugccaccau

SEQ ID NO: 1380284 - RNA, 24 nt, Human
caaagugcugggauuacaggcgug

SEQ ID NO: 1380285 - RNA, 19 nt, Human
caacaaagcaagaccucau

SEQ ID NO: 1380286 - RNA, 24 nt, Human
caccaugcccggcuaauuuuugua

SEQ ID NO: 1380287 - RNA, 21 nt, Human
caccauguuggccaggcuggu

SEQ ID NO: 1380288 - RNA, 24 nt, Human
caccauguuggccaggcuggucuc

SEQ ID NO: 1380289 - RNA, 24 nt, Human
cagcacuuuggaaggccaaagugg

SEQ ID NO: 1380290 - RNA, 24 nt, Human
caggguuucaccauguuggccagg

SEQ ID NO: 1380291 - RNA, 24 nt, Human
caguagagacaggguuucaccaug

SEQ ID NO: 1380292 - RNA, 26 nt, Human
caguagagacaggguuucaccauguu

SEQ ID NO: 1380293 - RNA, 22 nt, Human
cauacagaagaaaagaugcauc

SEQ ID NO: 1380294 - RNA, 23 nt, Human
cauacagaagaaaagaugcaucc

SEQ ID NO: 1380295 - RNA, 22 nt, Human
caucuggaaucccagcacuuug

SEQ ID NO: 1380296 - RNA, 24 nt, Human
cauguuggccaggcuggucucgaa

SEQ ID NO: 1380297 - RNA, 22 nt, Human
ccaaagugcugggauuacaggc

SEQ ID NO: 1380298 - RNA, 22 nt, Human
ccaaagugcugggauuacaggc

SEQ ID NO: 1380299 - RNA, 24 nt, Human
ccaaagugcugggauuacaggcgu

SEQ ID NO: 1380300 - RNA, 27 nt, Human
ccagccuagacaacaaagcaagaccuc

SEQ ID NO: 1380301 - RNA, 24 nt, Human
cccgaguagcugggauuacaggcg

SEQ ID NO: 1380302 - RNA, 18 nt, Human
cccuucccagacggcuca

SEQ ID NO: 1380303 - RNA, 22 nt, Human
ccgaguagcugggauuacaggc

SEQ ID NO: 1380304 - RNA, 21 nt, Human
ccguuggccucccaaagugcu

SEQ ID NO: 1380305 - RNA, 24 nt, Human
ccugccugagacucccgaguagcu

SEQ ID NO: 1380306 - RNA, 23 nt, Human
ccuggauucaagcaauucuccug

SEQ ID NO: 1380307 - RNA, 23 nt, Human
cgaguagcugggauuacaggcgc

SEQ ID NO: 1380308 - RNA, 19 nt, Human
cucaagugauccgcccccg

SEQ ID NO: 1380309 - RNA, 21 nt, Human
cucacugcaaccuccgccacc

SEQ ID NO: 1380310 - RNA, 24 nt, Human
cucgcaucuggaaucccagcacuu

SEQ ID NO: 1380311 - RNA, 24 nt, Human
cugcaaccuccgccaccuggauuc

SEQ ID NO: 1380312 - RNA, 20 nt, Human
cuugaguuaccaguguuucc

SEQ ID NO: 1380313 - RNA, 18 nt, Human
gaccucaagugauccgcc

SEQ ID NO: 1380314 - RNA, 21 nt, Human
gaccucaagugauccgccccc

SEQ ID NO: 1380315 - RNA, 26 nt, Human
gaguagcugggauuacaggcgcaugc

SEQ ID NO: 1380316 - RNA, 23 nt, Human
gaucgcuugagcccaguucaaga

SEQ ID NO: 1380317 - RNA, 18 nt, Human
gauuacaggcgcaugcca

SEQ ID NO: 1380318 - RNA, 24 nt, Human
gauuacaggcgcaugccaccaugc

SEQ ID NO: 1380319 - RNA, 18 nt, Human
gauuacaggcgugagcca

SEQ ID NO: 1380320 - RNA, 21 nt, Human
gauuacaggcgugagccacug

SEQ ID NO: 1380321 - RNA, 24 nt, Human
gauuacaggcgugagccacugugc

SEQ ID NO: 1380322 - RNA, 22 nt, Human
gcccggcuaauuuuuguauuuu

SEQ ID NO: 1380323 - RNA, 24 nt, Human
gcgguggcucgcaucuggaauccc

SEQ ID NO: 1380324 - RNA, 25 nt, Human
gcucuguugcccaggcuggggugca

SEQ ID NO: 1380325 - RNA, 24 nt, Human
ggcuggucucgaacuucugaccuc

SEQ ID NO: 1380326 - RNA, 22 nt, Human
ggguuucaccauguuggccagg

SEQ ID NO: 1380327 - RNA, 19 nt, Human
ggucucgaacuucugaccu

SEQ ID NO: 1380328 - RNA, 23 nt, Human
ggugcaguggcacgaucucggcu

SEQ ID NO: 1380329 - RNA, 24 nt, Human
ggugcaguggcacgaucucggcuc

SEQ ID NO: 1380330 - RNA, 24 nt, Human
gucuugcucuguugcccaggcugg

SEQ ID NO: 1380331 - RNA, 19 nt, Human
gugcaguggcacgaucucg

SEQ ID NO: 1380332 - RNA, 24 nt, Human
uaauuuuuguauuuucaguagaga

SEQ ID NO: 1380333 - RNA, 23 nt, Human
uacaggcgugagccacugugccc

SEQ ID NO: 1380334 - RNA, 24 nt, Human
uacaggcgugagccacugugccca

SEQ ID NO: 1380335 - RNA, 21 nt, Human
uagagacaggguuucaccaug

SEQ ID NO: 1380336 - RNA, 22 nt, Human
uagagacaggguuucaccaugu

SEQ ID NO: 1380337 - RNA, 22 nt, Human
uagaguucuugacucaagcaua

SEQ ID NO: 1380338 - RNA, 21 nt, Human
uauauacauggcugaaauuua

SEQ ID NO: 1380339 - RNA, 19 nt, Human
ucaagcaauucuccugccu

SEQ ID NO: 1380340 - RNA, 19 nt, Human
ucacugcaaccuccgccac

SEQ ID NO: 1380341 - RNA, 23 nt, Human
ucacugcaaccuccgccaccugg

SEQ ID NO: 1380342 - RNA, 24 nt, Human
ucacugcaaccuccgccaccugga

SEQ ID NO: 1380343 - RNA, 27 nt, Human
ucacugcaaccuccgccaccuggauuc

SEQ ID NO: 1380344 - RNA, 24 nt, Human
ucaguagagacaggguuucaccau

SEQ ID NO: 1380345 - RNA, 24 nt, Human
ucccaaagugcugggauuacaggc

SEQ ID NO: 1380346 - RNA, 24 nt, Human
ucccgaguagcugggauuacaggc

SEQ ID NO: 1380347 - RNA, 23 nt, Human
uccgcccccguuggccucccaaa

SEQ ID NO: 1380348 - RNA, 21 nt, Human
ucucgaacuucugaccucaag

SEQ ID NO: 1380349 - RNA, 24 nt, Human
ucuguugcccaggcuggggugcag

SEQ ID NO: 1380350 - RNA, 21 nt, Human
ucuuccuuuuuuuugagaugg

SEQ ID NO: 1380351 - RNA, 22 nt, Human
ucuugcucuguugcccaggcug

SEQ ID NO: 1380352 - RNA, 23 nt, Human
ucuugcucuguugcccaggcugg

SEQ ID NO: 1380353 - RNA, 23 nt, Human
ucuugcucuguugcccaggcugg

SEQ ID NO: 1380354 - RNA, 24 nt, Human
ucuugcucuguugcccaggcuggg

SEQ ID NO: 1380355 - RNA, 27 nt, Human
ucuugcucuguugcccaggcuggggug

SEQ ID NO: 1380356 - RNA, 20 nt, Human
ugaaaguucuggucuuuuug

SEQ ID NO: 1380357 - RNA, 18 nt, Human
ugaccucaagugauccgc

SEQ ID NO: 1380358 - RNA, 22 nt, Human
ugaccucaagugauccgccccc

SEQ ID NO: 1380359 - RNA, 21 nt, Human
ugacuugcagaagcacuacuu

SEQ ID NO: 1380360 - RNA, 22 nt, Human
ugagacucccgaguagcuggga

SEQ ID NO: 1380361 - RNA, 24 nt, Human
ugagacucccgaguagcugggauu

SEQ ID NO: 1380362 - RNA, 22 nt, Human
ugagauggagucuugcucuguu

SEQ ID NO: 1380363 - RNA, 20 nt, Human
ugagcccaguucaagaccag

SEQ ID NO: 1380364 - RNA, 18 nt, Human
ugcccaggcuggggugca

SEQ ID NO: 1380365 - RNA, 21 nt, Human
ugcccaggcuggggugcagug

SEQ ID NO: 1380366 - RNA, 22 nt, Human
ugcccaggcuggggugcagugg

SEQ ID NO: 1380367 - RNA, 24 nt, Human
ugcccggcuaauuuuuguauuuuc

SEQ ID NO: 1380368 - RNA, 21 nt, Human
ugccugagacucccgaguagc

SEQ ID NO: 1380369 - RNA, 25 nt, Human
ugcgguggcucgcaucuggaauccc

SEQ ID NO: 1380370 - RNA, 24 nt, Human
ugcucuguugcccaggcuggggug

SEQ ID NO: 1380371 - RNA, 24 nt, Human
ugcugggauuacaggcgugagcca

SEQ ID NO: 1380372 - RNA, 21 nt, Human
uggaaggccaaagugggagga

SEQ ID NO: 1380373 - RNA, 24 nt, Human
uggagucuugcucuguugcccagg

SEQ ID NO: 1380374 - RNA, 21 nt, Human
uggauucaagcaauucuccug

SEQ ID NO: 1380375 - RNA, 24 nt, Human
uggauucaagcaauucuccugccu

SEQ ID NO: 1380376 - RNA, 24 nt, Human
uggccaggcuggucucgaacuucu

SEQ ID NO: 1380377 - RNA, 22 nt, Human
uggcucgcaucuggaaucccag

SEQ ID NO: 1380378 - RNA, 24 nt, Human
uggcucgcaucuggaaucccagca

SEQ ID NO: 1380379 - RNA, 22 nt, Human
ugggaaaauuuuuuucaaucuu

SEQ ID NO: 1380380 - RNA, 21 nt, Human
ugggauuacaggcgcaugcca

SEQ ID NO: 1380381 - RNA, 22 nt, Human
ugggauuacaggcgcaugccac

SEQ ID NO: 1380382 - RNA, 24 nt, Human
ugggauuacaggcgcaugccacca

SEQ ID NO: 1380383 - RNA, 25 nt, Human
ugggauuacaggcgcaugccaccau

SEQ ID NO: 1380384 - RNA, 18 nt, Human
ugggauuacaggcgugag

SEQ ID NO: 1380385 - RNA, 21 nt, Human
ugggauuacaggcgugagcca

SEQ ID NO: 1380386 - RNA, 22 nt, Human
ugggauuacaggcgugagccac

SEQ ID NO: 1380387 - RNA, 22 nt, Human
ugggauuacaggcgugagccac

SEQ ID NO: 1380388 - RNA, 22 nt, Human
ugggauuacaggcgugagccac

SEQ ID NO: 1380389 - RNA, 24 nt, Human
ugggauuacaggcgugagccacug

SEQ ID NO: 1380390 - RNA, 26 nt, Human
ugggauuacaggcgugagccacugug

SEQ ID NO: 1380391 - RNA, 23 nt, Human
uggggugcaguggcacgaucucg

SEQ ID NO: 1380392 - RNA, 24 nt, Human
uggggugcaguggcacgaucucgg

SEQ ID NO: 1380393 - RNA, 18 nt, Human
uguagauguaaacacuga

SEQ ID NO: 1380394 - RNA, 24 nt, Human
uuaauggacuuucugauaagauuc

SEQ ID NO: 1380395 - RNA, 22 nt, Human
uuagaaaaauaauugggggacu

SEQ ID NO: 1380396 - RNA, 25 nt, Human
uucaagcaauucuccugccugagac

SEQ ID NO: 1380397 - RNA, 28 nt, Human
uucuuccuuuuuuuugagauggagucuu

SEQ ID NO: 1380398 - RNA, 22 nt, Human
uugaaggauaugcaaauccugg

SEQ ID NO: 1380399 - RNA, 19 nt, Human
uugacucaagcauacagaa

SEQ ID NO: 1380400 - RNA, 21 nt, Human
uugagauggagucuugcucug

SEQ ID NO: 1380401 - RNA, 24 nt, Human
uugcccaggcuggggugcaguggc

SEQ ID NO: 1380402 - RNA, 24 nt, Human
uugcucuguugcccaggcuggggu

SEQ ID NO: 1380403 - RNA, 18 nt, Human
uugcugcagcuuuaagca

SEQ ID NO: 1380404 - RNA, 18 nt, Human
uugggggacuggugcggu

SEQ ID NO: 1380405 - RNA, 20 nt, Human
uugggggacuggugcggugg

SEQ ID NO: 1380406 - RNA, 24 nt, Human
uuucaccauguuggccaggcuggu

SEQ ID NO: 1380407 - RNA, 24 nt, Human
uuuucaguagagacaggguuucac

SEQ ID NO: 1380408 - RNA, 20 nt, Human
uuuuuguauuuucaguagag

SEQ ID NO: 1380409 - RNA, 23 nt, Human
uuuuuguauuuucaguagagaca

SEQ ID NO: 1380410 - RNA, 19 nt, Human
aaacauccuggguaugugg

SEQ ID NO: 1380411 - RNA, 19 nt, Human
aagccucugaggagcccag

SEQ ID NO: 1380412 - RNA, 23 nt, Human
agcccuggcaauggcaggcagcc

SEQ ID NO: 1380413 - RNA, 23 nt, Human
agcuaugaccaggugaaaaccua

SEQ ID NO: 1380414 - RNA, 26 nt, Human
aggagccaggggcugcuccccaaacu

SEQ ID NO: 1380415 - RNA, 19 nt, Human
aggcuggagugcaguggca

SEQ ID NO: 1380416 - RNA, 26 nt, Human
agugacccagcuucaaccaugaggau

SEQ ID NO: 1380417 - RNA, 18 nt, Human
agugcaguggcaugauca

SEQ ID NO: 1380418 - RNA, 19 nt, Human
agugcaguggcaugaucac

SEQ ID NO: 1380419 - RNA, 21 nt, Human
agugcaguggcaugaucacag

SEQ ID NO: 1380420 - RNA, 20 nt, Human
aguggacagacccacucucc

SEQ ID NO: 1380421 - RNA, 24 nt, Human
auccaggcuggagugcaguggcau

SEQ ID NO: 1380422 - RNA, 18 nt, Human
aucccugaacaugccucc

SEQ ID NO: 1380423 - RNA, 18 nt, Human
aucuccuuccuucccaca

SEQ ID NO: 1380424 - RNA, 23 nt, Human
caaaagaucacacuuccccagca

SEQ ID NO: 1380425 - RNA, 20 nt, Human
caagaaaggcccugccugac

SEQ ID NO: 1380426 - RNA, 19 nt, Human
cagcagaaaaccacucagg

SEQ ID NO: 1380427 - RNA, 22 nt, Human
caggcagccugcugggaggcac

SEQ ID NO: 1380428 - RNA, 18 nt, Human
cagugugcccccaacaaa

SEQ ID NO: 1380429 - RNA, 20 nt, Human
caugggccaggcugaggugc

SEQ ID NO: 1380430 - RNA, 22 nt, Human
cccaccuccuccaagaagcaca

SEQ ID NO: 1380431 - RNA, 22 nt, Human
cccacucucccagugugccccc

SEQ ID NO: 1380432 - RNA, 24 nt, Human
cccacucucccagugugcccccaa

SEQ ID NO: 1380433 - RNA, 21 nt, Human
cccucuguaauguggcucuac

SEQ ID NO: 1380434 - RNA, 24 nt, Human
cccuuccgcacaucuccuuccuuc

SEQ ID NO: 1380435 - RNA, 24 nt, Human
ccgcacaucuccuuccuucccaca

SEQ ID NO: 1380436 - RNA, 18 nt, Human
ccucccauggguccagcu

SEQ ID NO: 1380437 - RNA, 20 nt, Human
ccucugaggagcccaggccu

SEQ ID NO: 1380438 - RNA, 21 nt, Human
ccugcacauucacugaguggc

SEQ ID NO: 1380439 - RNA, 24 nt, Human
ccuguaguuaggcauagccggggc

SEQ ID NO: 1380440 - RNA, 23 nt, Human
ccuguggugagcugcucugaggc

SEQ ID NO: 1380441 - RNA, 21 nt, Human
cgaguucacucuccugcuccu

SEQ ID NO: 1380442 - RNA, 23 nt, Human
cuccagaagccucugaggagccc

SEQ ID NO: 1380443 - RNA, 25 nt, Human
cuccuuuucacucaucuaaauuucc

SEQ ID NO: 1380444 - RNA, 24 nt, Human
cuggccaaaucagcacggacuuca

SEQ ID NO: 1380445 - RNA, 20 nt, Human
cuggcucuccaugcucuuuc

SEQ ID NO: 1380446 - RNA, 24 nt, Human
cuguggugagcugcucugaggcug

SEQ ID NO: 1380447 - RNA, 18 nt, Human
cuucccacaaacauccug

SEQ ID NO: 1380448 - RNA, 21 nt, Human
cuucgccuuuccuccuuuuca

SEQ ID NO: 1380449 - RNA, 19 nt, Human
gaaggguagcuugcaagga

SEQ ID NO: 1380450 - RNA, 21 nt, Human
gagccaggggcugcuccccaa

SEQ ID NO: 1380451 - RNA, 20 nt, Human
gcccccaacaaaagaucacc

SEQ ID NO: 1380452 - RNA, 22 nt, Human
gcucuccaugcucuuuccucag

SEQ ID NO: 1380453 - RNA, 19 nt, Human
gcuggagugcaguggcaug

SEQ ID NO: 1380454 - RNA, 24 nt, Human
gcugucauccaggcuggagugcag

SEQ ID NO: 1380455 - RNA, 20 nt, Human
ggagucucgcugucauccag

SEQ ID NO: 1380456 - RNA, 25 nt, Human
ggcaauggcaggcagccugcuggga

SEQ ID NO: 1380457 - RNA, 21 nt, Human
gggggucuguugcagcccuug

SEQ ID NO: 1380458 - RNA, 23 nt, Human
gucucgcugucauccaggcugga

SEQ ID NO: 1380459 - RNA, 22 nt, Human
ucacugaguggcuugcugaccc

SEQ ID NO: 1380460 - RNA, 21 nt, Human
ucagcagaaaaccacucaggc

SEQ ID NO: 1380461 - RNA, 24 nt, Human
ucauccaggcuggagugcaguggc

SEQ ID NO: 1380462 - RNA, 20 nt, Human
uccagaagccucugaggagc

SEQ ID NO: 1380463 - RNA, 21 nt, Human
uccagagggggucuguugcag

SEQ ID NO: 1380464 - RNA, 19 nt, Human
uccccagcacucccuguug

SEQ ID NO: 1380465 - RNA, 18 nt, Human
ucccuguaguuaggcaua

SEQ ID NO: 1380466 - RNA, 22 nt, Human
uccuaaggauacugggucucug

SEQ ID NO: 1380467 - RNA, 19 nt, Human
uccuguaaacuuccagagg

SEQ ID NO: 1380468 - RNA, 18 nt, Human
ucuccugggucccuuccg

SEQ ID NO: 1380469 - RNA, 21 nt, Human
ucucgcugucauccaggcugg

SEQ ID NO: 1380470 - RNA, 21 nt, Human
ucucgcugucauccaggcugg

SEQ ID NO: 1380471 - RNA, 22 nt, Human
ucucgcugucauccaggcugga

SEQ ID NO: 1380472 - RNA, 24 nt, Human
ucucgcugucauccaggcuggagu

SEQ ID NO: 1380473 - RNA, 19 nt, Human
ucucuggacagcacagacu

SEQ ID NO: 1380474 - RNA, 20 nt, Human
ugaagcugaugaguggaaug

SEQ ID NO: 1380475 - RNA, 23 nt, Human
ugcacauucacugaguggcuuuu

SEQ ID NO: 1380476 - RNA, 21 nt, Human
uggacagacccacucucccag

SEQ ID NO: 1380477 - RNA, 19 nt, Human
uggagugcaguggcaugau

SEQ ID NO: 1380478 - RNA, 19 nt, Human
uggagugcaguggcaugau

SEQ ID NO: 1380479 - RNA, 21 nt, Human
uggagugcaguggcaugauca

SEQ ID NO: 1380480 - RNA, 18 nt, Human
uggcaccccucaccagaa

SEQ ID NO: 1380481 - RNA, 24 nt, Human
uggcaccccucaccagaaauuccu

SEQ ID NO: 1380482 - RNA, 21 nt, Human
uggcgcacccugcugaaggcc

SEQ ID NO: 1380483 - RNA, 21 nt, Human
uggcgcacccugcugaaggcc

SEQ ID NO: 1380484 - RNA, 24 nt, Human
uggcucuccaugcucuuuccucag

SEQ ID NO: 1380485 - RNA, 22 nt, Human
uuccucagaaucugucuuugcc

SEQ ID NO: 1380486 - RNA, 24 nt, Human
uuggcaccccucaccagaaauucc

SEQ ID NO: 1380487 - RNA, 20 nt, Human
aaaauuaccuaguaauuucu

SEQ ID NO: 1380488 - RNA, 22 nt, Human
aagagcuccccacuuaaugccu

SEQ ID NO: 1380489 - RNA, 22 nt, Human
acgccuccugccccucccuauc

SEQ ID NO: 1380490 - RNA, 21 nt, Human
agagcuccccacuuaaugccu

SEQ ID NO: 1380491 - RNA, 18 nt, Human
auagaaaacagguuuugc

SEQ ID NO: 1380492 - RNA, 27 nt, Human
cccauagcuguagcauagccggggucc

SEQ ID NO: 1380493 - RNA, 19 nt, Human
cccggggcggcggucaugu

SEQ ID NO: 1380494 - RNA, 21 nt, Human
ccgcugggcggaccuucgugc

SEQ ID NO: 1380495 - RNA, 23 nt, Human
ccggggcggcggucauguugcgc

SEQ ID NO: 1380496 - RNA, 21 nt, Human
ccucacccugcugccgcuggg

SEQ ID NO: 1380497 - RNA, 22 nt, Human
ccucacccugcugccgcugggc

SEQ ID NO: 1380498 - RNA, 22 nt, Human
ccugccccucccuaucaggcca

SEQ ID NO: 1380499 - RNA, 20 nt, Human
ccuucugccuaccacccauu

SEQ ID NO: 1380500 - RNA, 25 nt, Human
ccuucugccuaccacccauuuggcc

SEQ ID NO: 1380501 - RNA, 24 nt, Human
cucuggugugcugcgccuggcucc

SEQ ID NO: 1380502 - RNA, 18 nt, Human
cugccuaccacccauuug

SEQ ID NO: 1380503 - RNA, 22 nt, Human
cugcugccucugugcaggcuga

SEQ ID NO: 1380504 - RNA, 24 nt, Human
cuucgugcacgccuccugccccuc

SEQ ID NO: 1380505 - RNA, 20 nt, Human
gcggagccagagagucuagc

SEQ ID NO: 1380506 - RNA, 19 nt, Human
gcgggucccggggcggcgg

SEQ ID NO: 1380507 - RNA, 28 nt, Human
gcuccuugucacugcugccucugugcag

SEQ ID NO: 1380508 - RNA, 22 nt, Human
ggcaggcuaagagcuccccucu

SEQ ID NO: 1380509 - RNA, 19 nt, Human
uaccacccauuuggccacg

SEQ ID NO: 1380510 - RNA, 23 nt, Human
uagaaaacagguuuugcagcuua

SEQ ID NO: 1380511 - RNA, 22 nt, Human
uagccggcgggucccggggcgg

SEQ ID NO: 1380512 - RNA, 21 nt, Human
uauacccaauugcccugucaa

SEQ ID NO: 1380513 - RNA, 24 nt, Human
uauacccaauugcccugucaaucu

SEQ ID NO: 1380514 - RNA, 20 nt, Human
uccagggcuguguuacccuu

SEQ ID NO: 1380515 - RNA, 21 nt, Human
ucccauagcuguagcauagcu

SEQ ID NO: 1380516 - RNA, 21 nt, Human
uccuugucacugcugccucug

SEQ ID NO: 1380517 - RNA, 20 nt, Human
ucgugcacgccuccugcccc

SEQ ID NO: 1380518 - RNA, 25 nt, Human
ucugugccaccuuuugucugugcug

SEQ ID NO: 1380519 - RNA, 23 nt, Human
ugccaugggccacccgcggagcc

SEQ ID NO: 1380520 - RNA, 20 nt, Human
ugcccaagguggggugaagc

SEQ ID NO: 1380521 - RNA, 23 nt, Human
ugcugccaaguauuuccuucugc

SEQ ID NO: 1380522 - RNA, 24 nt, Human
ugcugccaaguauuuccuucugcc

SEQ ID NO: 1380523 - RNA, 21 nt, Human
uggaagcacuugcuggcucca

SEQ ID NO: 1380524 - RNA, 18 nt, Human
ugggagaauccagggcug

SEQ ID NO: 1380525 - RNA, 23 nt, Human
ugggccacccgcggagccagaga

SEQ ID NO: 1380526 - RNA, 22 nt, Human
ugucugugccaccuuuugucug

SEQ ID NO: 1380527 - RNA, 21 nt, Human
uguuaaaagaaauggguuuau

SEQ ID NO: 1380528 - RNA, 31 nt, Human
uuaagauagaaaacagguuuugcagcuuauu

SEQ ID NO: 1380529 - RNA, 22 nt, Human
uuguauacaaggaacacaugaa

SEQ ID NO: 1380530 - RNA, 24 nt, Human
uuuggccacgcgguuucagccucu

SEQ ID NO: 1380531 - RNA, 24 nt, Human
aaagugcugggauaacaggcguga

SEQ ID NO: 1380532 - RNA, 23 nt, Human
aacccagaugccccaacucuccu

SEQ ID NO: 1380533 - RNA, 19 nt, Human
acaggccccggugugugau

SEQ ID NO: 1380534 - RNA, 21 nt, Human
acaggcgugagccacugcgcc

SEQ ID NO: 1380535 - RNA, 24 nt, Human
accuugugaucugccugccucggc

SEQ ID NO: 1380536 - RNA, 24 nt, Human
acggaguuuccccauguuggccag

SEQ ID NO: 1380537 - RNA, 21 nt, Human
acuacaccuauuaaagacguu

SEQ ID NO: 1380538 - RNA, 20 nt, Human
agaagcacuuccagaagaau

SEQ ID NO: 1380539 - RNA, 22 nt, Human
agccaugcaagccucaggcccu

SEQ ID NO: 1380540 - RNA, 24 nt, Human
agcgauucuccugccucagccucc

SEQ ID NO: 1380541 - RNA, 18 nt, Human
aguagcugggauuacagg

SEQ ID NO: 1380542 - RNA, 18 nt, Human
agugcaguggcgugaucu

SEQ ID NO: 1380543 - RNA, 20 nt, Human
agugcaguggcgugaucuug

SEQ ID NO: 1380544 - RNA, 24 nt, Human
agugcaguggcgugaucuugacuc

SEQ ID NO: 1380545 - RNA, 24 nt, Human
auuuuuguauuuuuaguagagacg

SEQ ID NO: 1380546 - RNA, 22 nt, Human
caaaccagcagccagaggcuga

SEQ ID NO: 1380547 - RNA, 24 nt, Human
caaagugcugggauaacaggcgug

SEQ ID NO: 1380548 - RNA, 19 nt, Human
caagccucaggcccucugu

SEQ ID NO: 1380549 - RNA, 22 nt, Human
caagcgauucuccugccucagc

SEQ ID NO: 1380550 - RNA, 21 nt, Human
cacgcucggcuaauuuuugua

SEQ ID NO: 1380551 - RNA, 30 nt, Human; identical to SEQ ID NO: 1297409

SEQ ID NO: 1380552 - RNA, 22 nt, Human
cacugcuaacccagaugcccca

SEQ ID NO: 1380553 - RNA, 19 nt, Human
caguggcgugaucuugacu

SEQ ID NO: 1380554 - RNA, 20 nt, Human
ccaaagugcugggauaacag

SEQ ID NO: 1380555 - RNA, 22 nt, Human
ccaaagugcugggauaacaggc

SEQ ID NO: 1380556 - RNA, 24 nt, Human
ccaaagugcugggauaacaggcgu

SEQ ID NO: 1380557 - RNA, 20 nt, Human
ccaacucuccucacucauau

SEQ ID NO: 1380558 - RNA, 21 nt, Human
ccaauaaguacugaacaccua

SEQ ID NO: 1380559 - RNA, 21 nt, Human
ccacugcgccuggccuacuua

SEQ ID NO: 1380560 - RNA, 22 nt, Human
ccauguuggccaggauggucuc

SEQ ID NO: 1380561 - RNA, 20 nt, Human
cccagguucaagcgauucuc

SEQ ID NO: 1380562 - RNA, 24 nt, Human
ccccauguuggccaggauggucuc

SEQ ID NO: 1380563 - RNA, 19 nt, Human
ccccgcccccacaacaggc

SEQ ID NO: 1380564 - RNA, 26 nt, Human
ccccgcccccacaacaggccccggug

SEQ ID NO: 1380565 - RNA, 23 nt, Human
cccgaguagcugggauuacaggu

SEQ ID NO: 1380566 - RNA, 24 nt, Human
cccgaguagcugggauuacaggug

SEQ ID NO: 1380567 - RNA, 18 nt, Human
cccgcccccacaacaggc

SEQ ID NO: 1380568 - RNA, 20 nt, Human
cccucuguuucuaccucugc

SEQ ID NO: 1380569 - RNA, 21 nt, Human
ccgaguagcugggauuacagg

SEQ ID NO: 1380570 - RNA, 24 nt, Human
ccgcccagguucaagcgauucucc

SEQ ID NO: 1380571 - RNA, 22 nt, Human
ccgcccccacaacaggccccgg

SEQ ID NO: 1380572 - RNA, 23 nt, Human
ccugccucagccucccgaguagc

SEQ ID NO: 1380573 - RNA, 24 nt, Human
ccugccucagccucccgaguagcu

SEQ ID NO: 1380574 - RNA, 26 nt, Human
cuacugcacucccuucuccccaaguc

SEQ ID NO: 1380575 - RNA, 18 nt, Human
cucacugcaaccucugcc

SEQ ID NO: 1380576 - RNA, 23 nt, Human
cucagccucccgaguagcuggga

SEQ ID NO: 1380577 - RNA, 23 nt, Human
cucaggcccucuguuucuaccuc

SEQ ID NO: 1380578 - RNA, 24 nt, Human
cugcaaccucugccgcccagguuc

SEQ ID NO: 1380579 - RNA, 24 nt, Human
cugcacccauuaacucgucauuua

SEQ ID NO: 1380580 - RNA, 23 nt, Human
cugccucggccucccaaagugcu

SEQ ID NO: 1380581 - RNA, 22 nt, Human
gaccuugugaucugccugccuc

SEQ ID NO: 1380582 - RNA, 24 nt, Human
gaccuugugaucugccugccucgg

SEQ ID NO: 1380583 - RNA, 20 nt, Human
gagacggaguuuccccaugu

SEQ ID NO: 1380584 - RNA, 26 nt, Human
gaguagcugggauuacaggugcauac

SEQ ID NO: 1380585 - RNA, 18 nt, Human
gauaacaggcgugagcca

SEQ ID NO: 1380586 - RNA, 22 nt, Human
gauaacaggcgugagccacugc

SEQ ID NO: 1380587 - RNA, 22 nt, Human
gauaacaggcgugagccacugc

SEQ ID NO: 1380588 - RNA, 20 nt, Human
gaugcaaggugguagagagc

SEQ ID NO: 1380589 - RNA, 22 nt, Human
gcaaccucugccgcccagguuc

SEQ ID NO: 1380590 - RNA, 21 nt, Human
gcaaggugguagagagcagau

SEQ ID NO: 1380591 - RNA, 24 nt, Human
gcccagguucaagcgauucuccug

SEQ ID NO: 1380592 - RNA, 24 nt, Human
gcgauucuccugccucagccuccc

SEQ ID NO: 1380593 - RNA, 18 nt, Human
gcgugaucuugacucacu

SEQ ID NO: 1380594 - RNA, 22 nt, Human
gcuuucccucccccgcccccac

SEQ ID NO: 1380595 - RNA, 23 nt, Human
ggaguuuccccauguuggccagg

SEQ ID NO: 1380596 - RNA, 22 nt, Human
ggcuguagugcaguggcgugau

SEQ ID NO: 1380597 - RNA, 18 nt, Human
ggguacgugugcacaacg

SEQ ID NO: 1380598 - RNA, 18 nt, Human
guagcugggauuacaggu

SEQ ID NO: 1380599 - RNA, 24 nt, Human
guccaggcuguagugcaguggcgu

SEQ ID NO: 1380600 - RNA, 26 nt, Human
uaacagaagcacuuccagaagaauuc

SEQ ID NO: 1380601 - RNA, 19 nt, Human
uaacagaugcaagguggua

SEQ ID NO: 1380602 - RNA, 24 nt, Human
uaacuacugcacucccuucucccc

SEQ ID NO: 1380603 - RNA, 24 nt, Human
uaauuuuuguauuuuuaguagaga

SEQ ID NO: 1380604 - RNA, 21 nt, Human
uacugcacucccuucucccca

SEQ ID NO: 1380605 - RNA, 21 nt, Human
uaggaaaaaaucuagcuucua

SEQ ID NO: 1380606 - RNA, 24 nt, Human
uaguagagacggaguuuccccaug

SEQ ID NO: 1380607 - RNA, 23 nt, Human
uauaaacacugcuaacccagaug

SEQ ID NO: 1380608 - RNA, 20 nt, Human
ucaaaccagcagccagaggc

SEQ ID NO: 1380609 - RNA, 18 nt, Human
ucacugcaaccucugccg

SEQ ID NO: 1380610 - RNA, 21 nt, Human
ucacugcaaccucugccgccc

SEQ ID NO: 1380611 - RNA, 24 nt, Human
ucacugcaaccucugccgcccagg

SEQ ID NO: 1380612 - RNA, 20 nt, Human
ucagccucccgaguagcugg

SEQ ID NO: 1380613 - RNA, 24 nt, Human
ucccaaagugcugggauaacaggc

SEQ ID NO: 1380614 - RNA, 23 nt, Human
ucccgaguagcugggauuacagg

SEQ ID NO: 1380615 - RNA, 24 nt, Human
ucccgaguagcugggauuacaggu

SEQ ID NO: 1380616 - RNA, 18 nt, Human
ucggccucccaaagugcu

SEQ ID NO: 1380617 - RNA, 24 nt, Human
ucguccaggcuguagugcaguggc

SEQ ID NO: 1380618 - RNA, 21 nt, Human
ucuccucacucauauuucaaa

SEQ ID NO: 1380619 - RNA, 24 nt, Human
ucuccugccucagccucccgagua

SEQ ID NO: 1380620 - RNA, 19 nt, Human
ucugcugggagagauaggg

SEQ ID NO: 1380621 - RNA, 24 nt, Human
ucugucguccaggcuguagugcag

SEQ ID NO: 1380622 - RNA, 19 nt, Human
ucuugcucugucguccagg

SEQ ID NO: 1380623 - RNA, 22 nt, Human
ucuugcucugucguccaggcug

SEQ ID NO: 1380624 - RNA, 23 nt, Human
ucuugcucugucguccaggcugu

SEQ ID NO: 1380625 - RNA, 18 nt, Human
ugagacagagucuugcuc

SEQ ID NO: 1380626 - RNA, 22 nt, Human
ugagacagagucuugcucuguc

SEQ ID NO: 1380627 - RNA, 21 nt, Human
ugcagguuuguuacauaugua

SEQ ID NO: 1380628 - RNA, 24 nt, Human
ugccucagccucccgaguagcugg

SEQ ID NO: 1380629 - RNA, 21 nt, Human
ugccucggccucccaaagugc

SEQ ID NO: 1380630 - RNA, 24 nt, Human
ugccucggccucccaaagugcugg

SEQ ID NO: 1380631 - RNA, 21 nt, Human
ugcgccuggccuacuuaguuu

SEQ ID NO: 1380632 - RNA, 24 nt, Human
ugcucugucguccaggcuguagug

SEQ ID NO: 1380633 - RNA, 22 nt, Human
uggccaggauggucucgaucuc

SEQ ID NO: 1380634 - RNA, 20 nt, Human
ugggagagauagggcugaau

SEQ ID NO: 1380635 - RNA, 19 nt, Human
ugggauaacaggcgugagc

SEQ ID NO: 1380636 - RNA, 22 nt, Human
ugggauaacaggcgugagccac

SEQ ID NO: 1380637 - RNA, 22 nt, Human
ugggauaacaggcgugagccac

SEQ ID NO: 1380638 - RNA, 24 nt, Human
ugggauaacaggcgugagccacug

SEQ ID NO: 1380639 - RNA, 21 nt, Human
ugggauuacaggugcauacca

SEQ ID NO: 1380640 - RNA, 21 nt, Human
ugggauuacaggugcauacca

SEQ ID NO: 1380641 - RNA, 22 nt, Human
ugggauuacaggugcauaccau

SEQ ID NO: 1380642 - RNA, 24 nt, Human
ugggauuacaggugcauaccauca

SEQ ID NO: 1380643 - RNA, 21 nt, Human
ugguagagagcagauuaggaa

SEQ ID NO: 1380644 - RNA, 19 nt, Human
uguagugcaguggcgugau

SEQ ID NO: 1380645 - RNA, 19 nt, Human
uguagugcaguggcgugau

SEQ ID NO: 1380646 - RNA, 28 nt, Human
uguagugcaguggcgugauggcucuagc

SEQ ID NO: 1380647 - RNA, 18 nt, Human
uguuacauauguauacau

SEQ ID NO: 1380648 - RNA, 19 nt, Human
uguuacauauguauacaug

SEQ ID NO: 1380649 - RNA, 18 nt, Human
uuaguagagacggaguuu

SEQ ID NO: 1380650 - RNA, 24 nt, Human
uuaguagagacggaguuuccccau

SEQ ID NO: 1380651 - RNA, 21 nt, Human
uucaagcgauucuccugccuc

SEQ ID NO: 1380652 - RNA, 23 nt, Human
uucaagcgauucuccugccucag

SEQ ID NO: 1380653 - RNA, 24 nt, Human
uucaagcgauucuccugccucagc

SEQ ID NO: 1380654 - RNA, 23 nt, Human
uuguauuuuuaguagagacggag

SEQ ID NO: 1380655 - RNA, 25 nt, Human
uuuauucaaacuaagucaugaaauc

SEQ ID NO: 1380656 - RNA, 19 nt, Human
uuuccccauguuggccagg

SEQ ID NO: 1380657 - RNA, 19 nt, Human
uuuuuaguagagacggagu

SEQ ID NO: 1380658 - RNA, 20 nt, Human
uuuuuguauuuuuaguagag

SEQ ID NO: 1380659 - RNA, 20 nt, Human
uuuuuuuuuuugagacagag

SEQ ID NO: 1380660 - RNA, 24 nt, Human
uuuuuuuuuuuugagacagagucu

SEQ ID NO: 1380661 - RNA, 20 nt, Human
aaagaguccccaauuuacag

SEQ ID NO: 1380662 - RNA, 18 nt, Human
aaagugcugggauuacag

SEQ ID NO: 1380663 - RNA, 18 nt, Human
aacaacagcaaccaaaag

SEQ ID NO: 1380664 - RNA, 19 nt, Human
aacaacagcaaccaaaaga

SEQ ID NO: 1380665 - RNA, 26 nt, Human
aagugcugggauuacagccacgagcu

SEQ ID NO: 1380666 - RNA, 24 nt, Human
acacaggcuggagugcagugguau

SEQ ID NO: 1380667 - RNA, 22 nt, Human
aggagggaggcugcccucuuua

SEQ ID NO: 1380668 - RNA, 23 nt, Human
agugcagugguaugcucauagcu

SEQ ID NO: 1380669 - RNA, 24 nt, Human
agugcugggauuacagccacgagc

SEQ ID NO: 1380670 - RNA, 18 nt, Human
auagcucacugcagccuc

SEQ ID NO: 1380671 - RNA, 19 nt, Human
caaagguuucauaaaggca

SEQ ID NO: 1380672 - RNA, 20 nt, Human
cagccucgaacuccugggcu

SEQ ID NO: 1380673 - RNA, 24 nt, Human
cagccucgaacuccugggcucaaa

SEQ ID NO: 1380674 - RNA, 20 nt, Human
caggaaaagcugcaguaggu

SEQ ID NO: 1380675 - RNA, 23 nt, Human
caggaaaagcugcaguagguggc

SEQ ID NO: 1380676 - RNA, 21 nt, Human
cauuucagacagguacaucgu

SEQ ID NO: 1380677 - RNA, 19 nt, Human
ccacacccagccaagggca

SEQ ID NO: 1380678 - RNA, 21 nt, Human
cccaauauaaucagcaaaaca

SEQ ID NO: 1380679 - RNA, 21 nt, Human
cccacucuguuucuuauuugg

SEQ ID NO: 1380680 - RNA, 22 nt, Human
ccgagcucgcgcuggcuccggc

SEQ ID NO: 1380681 - RNA, 22 nt, Human
ccggcggagccgcugcucuccc

SEQ ID NO: 1380682 - RNA, 19 nt, Human
ccucgaacuccugggcuca

SEQ ID NO: 1380683 - RNA, 25 nt, Human
cgaacuccugggcucaaacgauccu

SEQ ID NO: 1380684 - RNA, 21 nt, Human
cgagcuaccacacccagccaa

SEQ ID NO: 1380685 - RNA, 22 nt, Human
cggaccggguguccaccgugcc

SEQ ID NO: 1380686 - RNA, 24 nt, Human
cgggcaccagccggcuugccggcc

SEQ ID NO: 1380687 - RNA, 19 nt, Human
cuaaagugcugggauuaca

SEQ ID NO: 1380688 - RNA, 21 nt, Human
cucacugcagccucgaacucc

SEQ ID NO: 1380689 - RNA, 24 nt, Human
cucacugcagccucgaacuccugg

SEQ ID NO: 1380690 - RNA, 18 nt, Human
gagcucgcgcuggcuccg

SEQ ID NO: 1380691 - RNA, 20 nt, Human
gaguccccaauuuacagucc

SEQ ID NO: 1380692 - RNA, 20 nt, Human
gccuggguguggggucuugg

SEQ ID NO: 1380693 - RNA, 22 nt, Human
gccuuggcuuccuaaagugcug

SEQ ID NO: 1380694 - RNA, 19 nt, Human
ggcucuuucacacaggcug

SEQ ID NO: 1380695 - RNA, 23 nt, Human
uaaagugcugggauuacagccac

SEQ ID NO: 1380696 - RNA, 20 nt, Human
uaacaacagcaaccaaaaga

SEQ ID NO: 1380697 - RNA, 24 nt, Human
uaacaacagcaaccaaaagacuga

SEQ ID NO: 1380698 - RNA, 24 nt, Human
uacagccacgagcuaccacaccca

SEQ ID NO: 1380699 - RNA, 20 nt, Human
uaccacacccagccaagggc

SEQ ID NO: 1380700 - RNA, 24 nt, Human
uagcucacugcagccucgaacucc

SEQ ID NO: 1380701 - RNA, 24 nt, Human
ucacugcagccucgaacuccuggg

SEQ ID NO: 1380702 - RNA, 23 nt, Human
uccuaaagugcugggauuacagc

SEQ ID NO: 1380703 - RNA, 20 nt, Human
uccugggcucaaacgauccu

SEQ ID NO: 1380704 - RNA, 23 nt, Human
ucuggcucuuucacacaggcugg

SEQ ID NO: 1380705 - RNA, 18 nt, Human
ugccccaggcccuccagg

SEQ ID NO: 1380706 - RNA, 21 nt, Human
uggagugcagugguaugcuca

SEQ ID NO: 1380707 - RNA, 23 nt, Human
uggauugagccugucuuugaagu

SEQ ID NO: 1380708 - RNA, 22 nt, Human
ugggauuacagccacgagcuac

SEQ ID NO: 1380709 - RNA, 24 nt, Human
ugggauuacagccacgagcuacca

SEQ ID NO: 1380710 - RNA, 24 nt, Human
ugguaugcucauagcucacugcag

SEQ ID NO: 1380711 - RNA, 21 nt, Human
uuucacacaggcuggagugca

SEQ ID NO: 1380712 - RNA, 21 nt, Human
aaaagcaccagucuccaugcc

SEQ ID NO: 1380713 - RNA, 23 nt, Human
aaacaauuuucucacacaaaacu

SEQ ID NO: 1380714 - RNA, 21 nt, Human
aaacugccuacucaagccuca

SEQ ID NO: 1380715 - RNA, 21 nt, Human
aacaaaguuuuauuaccccca

SEQ ID NO: 1380716 - RNA, 25 nt, Human
aaccaaucccagugagaugaaccgg

SEQ ID NO: 1380717 - RNA, 21 nt, Human
aagaacaguaaaauaaccaac

SEQ ID NO: 1380718 - RNA, 20 nt, Human
aagacucuguggaucagcca

SEQ ID NO: 1380719 - RNA, 23 nt, Human
acaaaauugcaugaggcucaaaa

SEQ ID NO: 1380720 - RNA, 20 nt, Human
acagguauuaacugauuacu

SEQ ID NO: 1380721 - RNA, 20 nt, Human
acccuagaaguaaaagacuc

SEQ ID NO: 1380722 - RNA, 20 nt, Human
accgccuccccaccaaaauc

SEQ ID NO: 1380723 - RNA, 18 nt, Human
accuggcccacuuaauaa

SEQ ID NO: 1380724 - RNA, 23 nt, Human
acuaaaugcuucuucauuauccc

SEQ ID NO: 1380725 - RNA, 22 nt, Human
acuauguuauuacuaaagcauu

SEQ ID NO: 1380726 - RNA, 19 nt, Human
acuggggcugcugccuuuc

SEQ ID NO: 1380727 - RNA, 19 nt, Human
acugugcugggagauccgu

SEQ ID NO: 1380728 - RNA, 24 nt, Human
agaaaucaacaagccaaauaucau

SEQ ID NO: 1380729 - RNA, 21 nt, Human
agaacuucaaauguguuacua

SEQ ID NO: 1380730 - RNA, 24 nt, Human
agaagcacggcaugaaaagcacca

SEQ ID NO: 1380731 - RNA, 18 nt, Human
agaauccaaggucuuggc

SEQ ID NO: 1380732 - RNA, 21 nt, Human
agaauccaaggucuuggcccc

SEQ ID NO: 1380733 - RNA, 21 nt, Human
agacuauaucagaggaagcaa

SEQ ID NO: 1380734 - RNA, 18 nt, Human
agccacaucuaccucccc

SEQ ID NO: 1380735 - RNA, 18 nt, Human
agccagaacuucaaaugu

SEQ ID NO: 1380736 - RNA, 21 nt, Human
agccagaacuucaaauguguu

SEQ ID NO: 1380737 - RNA, 22 nt, Human
agcuuccuugcauuggguuaga

SEQ ID NO: 1380738 - RNA, 19 nt, Human
agcuuuguaaccucaaguu

SEQ ID NO: 1380739 - RNA, 21 nt, Human
aggcaggaacguuaaagucug

SEQ ID NO: 1380740 - RNA, 23 nt, Human
agguauucugauuuuuggaauuu

SEQ ID NO: 1380741 - RNA, 22 nt, Human
aguaggcaauaaguuuuuaaac

SEQ ID NO: 1380742 - RNA, 21 nt, Human
auaaaauguuucaugucuuca

SEQ ID NO: 1380743 - RNA, 21 nt, Human
auacugcaacaacuucauuua

SEQ ID NO: 1380744 - RNA, 21 nt, Human
aucuaccuuuggucuuugcug

SEQ ID NO: 1380745 - RNA, 23 nt, Human
aucucauuuaucuuugaaauucc

SEQ ID NO: 1380746 - RNA, 18 nt, Human
augcagucauuacagaug

SEQ ID NO: 1380747 - RNA, 18 nt, Human
auggaagacaaccucugc

SEQ ID NO: 1380748 - RNA, 20 nt, Human
auuuaucuaccuuuggucuu

SEQ ID NO: 1380749 - RNA, 23 nt, Human
caaaacagacuaagugccagcca

SEQ ID NO: 1380750 - RNA, 22 nt, Human
caaaauugcaugaggcucaaaa

SEQ ID NO: 1380751 - RNA, 23 nt, Human
caagaacaguaaaauaaccaaca

SEQ ID NO: 1380752 - RNA, 19 nt, Human
caccaaaaucugcagaagc

SEQ ID NO: 1380753 - RNA, 19 nt, Human
caccaagaaauaaagucaa

SEQ ID NO: 1380754 - RNA, 20 nt, Human
cacugggagcugcagaccag

SEQ ID NO: 1380755 - RNA, 21 nt, Human
cacuucaggaaaaugcaagaa

SEQ ID NO: 1380756 - RNA, 21 nt, Human
cagagauucucuuagagcuga

SEQ ID NO: 1380757 - RNA, 18 nt, Human
cagccaucuugccuggga

SEQ ID NO: 1380758 - RNA, 23 nt, Human
cauucuuuacauaaguacugagu

SEQ ID NO: 1380759 - RNA, 23 nt, Human
cauuuccacaccaagaaauaaag

SEQ ID NO: 1380760 - RNA, 22 nt, Human
ccaaauaucauuacaaugugcu

SEQ ID NO: 1380761 - RNA, 21 nt, Human
ccaagcuagagugucccaggu

SEQ ID NO: 1380762 - RNA, 21 nt, Human
ccacaucuaccuccccacuga

SEQ ID NO: 1380763 - RNA, 22 nt, Human
ccaccuugacccuagaaguaaa

SEQ ID NO: 1380764 - RNA, 23 nt, Human
ccacuagacugcagccacugugc

SEQ ID NO: 1380765 - RNA, 21 nt, Human
ccacugugcuuacaguugcgu

SEQ ID NO: 1380766 - RNA, 25 nt, Human
cccacacaaucaagaacaguauaua

SEQ ID NO: 1380767 - RNA, 18 nt, Human
cccuagagaucaaaaacc

SEQ ID NO: 1380768 - RNA, 21 nt, Human
cccuauuaccgccuccccacc

SEQ ID NO: 1380769 - RNA, 23 nt, Human
ccucagccacaucuaccucccca

SEQ ID NO: 1380770 - RNA, 22 nt, Human
ccugaccaguguugcccaggga

SEQ ID NO: 1380771 - RNA, 20 nt, Human
ccugcaggugcucuguccca

SEQ ID NO: 1380772 - RNA, 22 nt, Human
cgccuucuguguuggucucacu

SEQ ID NO: 1380773 - RNA, 19 nt, Human
cuaagcaccacuguuuuac

SEQ ID NO: 1380774 - RNA, 20 nt, Human
cucaccauaaccaacaagac

SEQ ID NO: 1380775 - RNA, 21 nt, Human
cuccucagccacaucuaccuc

SEQ ID NO: 1380776 - RNA, 22 nt, Human
cucuucuuccaaccugcucucc

SEQ ID NO: 1380777 - RNA, 20 nt, Human
cugaagcugcgccuacagcc

SEQ ID NO: 1380778 - RNA, 21 nt, Human
cugauauccuuucuuucacuu

SEQ ID NO: 1380779 - RNA, 23 nt, Human
cugcaguggacuccacacagucc

SEQ ID NO: 1380780 - RNA, 18 nt, Human
cuguguaggaggaagcag

SEQ ID NO: 1380781 - RNA, 21 nt, Human
cuuacaguugcguagagcacu

SEQ ID NO: 1380782 - RNA, 22 nt, Human
cuuccaagcuagagugucccag

SEQ ID NO: 1380783 - RNA, 19 nt, Human
cuuggcucccuggcuucag

SEQ ID NO: 1380784 - RNA, 27 nt, Human
cuuucuuucagagaugcccugcccaga

SEQ ID NO: 1380785 - RNA, 24 nt, Human
gaagacagccacaugggacuugaa

SEQ ID NO: 1380786 - RNA, 24 nt, Human
gaagcacggcaugaaaagcaccag

SEQ ID NO: 1380787 - RNA, 21 nt, Human
gagccaugaaucaaucauuua

SEQ ID NO: 1380788 - RNA, 25 nt, Human
gaggauaaccugauacugagcuuug

SEQ ID NO: 1380789 - RNA, 22 nt, Human
ggaaaugaggauuacagaggaa

SEQ ID NO: 1380790 - RNA, 18 nt, Human
ggaagacaaccucugcag

SEQ ID NO: 1380791 - RNA, 20 nt, Human
ggagccaauaauuguaaguc

SEQ ID NO: 1380792 - RNA, 20 nt, Human
ggcacugucauccuucuuau

SEQ ID NO: 1380793 - RNA, 22 nt, Human
guagaacacuucuguacacccc

SEQ ID NO: 1380794 - RNA, 21 nt, Human
guagaagacgccuuaccugug

SEQ ID NO: 1380795 - RNA, 24 nt, Human
gucaauuucagacugcugugcugg

SEQ ID NO: 1380796 - RNA, 26 nt, Human
guuucuaguggaguggaaaucaaguu

SEQ ID NO: 1380797 - RNA, 20 nt, Human
uaaaaaaaguuuaccuucag

SEQ ID NO: 1380798 - RNA, 22 nt, Human
uaaaauaaccaacaugcaguua

SEQ ID NO: 1380799 - RNA, 24 nt, Human
uaaaaugaacaagauagaaagaua

SEQ ID NO: 1380800 - RNA, 23 nt, Human
uaaaguguuuucaaaugagcacu

SEQ ID NO: 1380801 - RNA, 22 nt, Human
uaaauaauuugcucaagucucc

SEQ ID NO: 1380802 - RNA, 19 nt, Human
uaaaugucuacuguugaau

SEQ ID NO: 1380803 - RNA, 21 nt, Human
uaacagucaggccccuuugcu

SEQ ID NO: 1380804 - RNA, 23 nt, Human
uaacucggagcugucugucucuc

SEQ ID NO: 1380805 - RNA, 22 nt, Human
uaagaaaaaagguuuuuuucac

SEQ ID NO: 1380806 - RNA, 21 nt, Human
uaagacauacaaagagaacaa

SEQ ID NO: 1380807 - RNA, 21 nt, Human
uaagcaaaacagacuaagugc

SEQ ID NO: 1380808 - RNA, 23 nt, Human
uaaguaauaagcaaaacagacua

SEQ ID NO: 1380809 - RNA, 25 nt, Human
uaauaagcaaaacagacuaagugcc

SEQ ID NO: 1380810 - RNA, 21 nt, Human
uacagccgccccuuccugcag

SEQ ID NO: 1380811 - RNA, 25 nt, Human
uacauuaagacauacaaagagaaca

SEQ ID NO: 1380812 - RNA, 23 nt, Human
uacccccauuuuagagucgagga

SEQ ID NO: 1380813 - RNA, 22 nt, Human
uagaaagauagauuuguagaua

SEQ ID NO: 1380814 - RNA, 19 nt, Human
uagaaggaagacagccaca

SEQ ID NO: 1380815 - RNA, 18 nt, Human
uagacgucccucccccuu

SEQ ID NO: 1380816 - RNA, 22 nt, Human
uagauagauagauagauaggca

SEQ ID NO: 1380817 - RNA, 22 nt, Human
uagauccauucaucugucccuc

SEQ ID NO: 1380818 - RNA, 24 nt, Human
uauaaaguguuuucaaaugagcac

SEQ ID NO: 1380819 - RNA, 22 nt, Human
uaucauuacaaugugcuaccca

SEQ ID NO: 1380820 - RNA, 23 nt, Human
uaugcagucauuacagaugcugu

SEQ ID NO: 1380821 - RNA, 19 nt, Human
uaugcauaucacauaugua

SEQ ID NO: 1380822 - RNA, 19 nt, Human
uaugugugccuauuggcaa

SEQ ID NO: 1380823 - RNA, 22 nt, Human
uauguucuucucuaaacuaguu

SEQ ID NO: 1380824 - RNA, 22 nt, Human
uauuucauuaaguugaucuuca

SEQ ID NO: 1380825 - RNA, 21 nt, Human
ucaaaaauauauggggggaaa

SEQ ID NO: 1380826 - RNA, 21 nt, Human
ucaacaauuggcuuggaacuc

SEQ ID NO: 1380827 - RNA, 21 nt, Human
ucacuugaucaauucagcuau

SEQ ID NO: 1380828 - RNA, 26 nt, Human
ucagacauuacaauuuaaaccaugcc

SEQ ID NO: 1380829 - RNA, 21 nt, Human
ucaguuggaaaugcaaaaauc

SEQ ID NO: 1380830 - RNA, 25 nt, Human
uccacacaguccgaacuuccaggcg

SEQ ID NO: 1380831 - RNA, 20 nt, Human
uccacaccaagaaauaaagu

SEQ ID NO: 1380832 - RNA, 22 nt, Human
uccagggugagcaaauucaaug

SEQ ID NO: 1380833 - RNA, 18 nt, Human
ucccagaggggcaccugc

SEQ ID NO: 1380834 - RNA, 23 nt, Human
ucccagcuagaaagagccagagc

SEQ ID NO: 1380835 - RNA, 22 nt, Human
ucccaggucaauuucagacugc

SEQ ID NO: 1380836 - RNA, 23 nt, Human
uccccuauuaccgccuccccacc

SEQ ID NO: 1380837 - RNA, 22 nt, Human
ucccuaaaaugaacaagauaga

SEQ ID NO: 1380838 - RNA, 22 nt, Human
ucccuaaaaugaacaagauaga

SEQ ID NO: 1380839 - RNA, 22 nt, Human
ucccucccccuuccaagcuaga

SEQ ID NO: 1380840 - RNA, 19 nt, Human
uccucagccacaucuaccu

SEQ ID NO: 1380841 - RNA, 24 nt, Human
ucguguaagauaauucucgacugu

SEQ ID NO: 1380842 - RNA, 19 nt, Human
ucuaaacuaguuauucuag

SEQ ID NO: 1380843 - RNA, 19 nt, Human
ucuauaagcuuugagauuu

SEQ ID NO: 1380844 - RNA, 19 nt, Human
ucucuuagagcugagaaau

SEQ ID NO: 1380845 - RNA, 19 nt, Human
ucugucccuccucagccac

SEQ ID NO: 1380846 - RNA, 24 nt, Human
ucuuucagagaugcccugcccaga

SEQ ID NO: 1380847 - RNA, 19 nt, Human
ugaaacgccgaacauguaa

SEQ ID NO: 1380848 - RNA, 24 nt, Human
ugaauaagucauuuccacaccaag

SEQ ID NO: 1380849 - RNA, 23 nt, Human
ugaauacagaacuaccugugacc

SEQ ID NO: 1380850 - RNA, 22 nt, Human
ugagcaaauucaauguuuucaa

SEQ ID NO: 1380851 - RNA, 22 nt, Human
ugagcaagaccacuuggcuccc

SEQ ID NO: 1380852 - RNA, 22 nt, Human
ugagggaaaugaggauuacaga

SEQ ID NO: 1380853 - RNA, 26 nt, Human
ugagugccugcuauauggaaaaucuu

SEQ ID NO: 1380854 - RNA, 21 nt, Human
ugcaagaauuguuuaugcagu

SEQ ID NO: 1380855 - RNA, 18 nt, Human
ugcaguggacuccacaca

SEQ ID NO: 1380856 - RNA, 23 nt, Human
ugccuauuggcaaaagcagagau

SEQ ID NO: 1380857 - RNA, 21 nt, Human
ugcuacccaggucuguccaaa

SEQ ID NO: 1380858 - RNA, 20 nt, Human
ugcugggagauauuuccccg

SEQ ID NO: 1380859 - RNA, 20 nt, Human
uggaacucuuaggguuacau

SEQ ID NO: 1380860 - RNA, 23 nt, Human
uggaagauaagagguauucugau

SEQ ID NO: 1380861 - RNA, 20 nt, Human
uggcaaagauagaaucucau

SEQ ID NO: 1380862 - RNA, 23 nt, Human
uggcaaagauagaaucucauuua

SEQ ID NO: 1380863 - RNA, 19 nt, Human
uggcaaugcauagggauug

SEQ ID NO: 1380864 - RNA, 23 nt, Human
uggcuccaguguuuuaaacauac

SEQ ID NO: 1380865 - RNA, 20 nt, Human
uggcucccuggcuucagccc

SEQ ID NO: 1380866 - RNA, 20 nt, Human
uggcuuggaacucuuagggu

SEQ ID NO: 1380867 - RNA, 23 nt, Human
ugggcuguguuuuucagcuucau

SEQ ID NO: 1380868 - RNA, 23 nt, Human
uggggcugcugccuuucuuucag

SEQ ID NO: 1380869 - RNA, 22 nt, Human
uggggggaaaaauuccuguaau

SEQ ID NO: 1380870 - RNA, 26 nt, Human
uguaaaaaaaguuuaccuucagcaag

SEQ ID NO: 1380871 - RNA, 18 nt, Human
ugucaaggaaaaguaggc

SEQ ID NO: 1380872 - RNA, 22 nt, Human
ugucaaggaaaaguaggcaaua

SEQ ID NO: 1380873 - RNA, 19 nt, Human
ugucacacaauaugguaca

SEQ ID NO: 1380874 - RNA, 21 nt, Human
ugugaccccaaaauauuucca

SEQ ID NO: 1380875 - RNA, 22 nt, Human
uguuguguuuuuggagcauguu

SEQ ID NO: 1380876 - RNA, 18 nt, Human
uuaaaacaaauugacuca

SEQ ID NO: 1380877 - RNA, 20 nt, Human
uucacccuuuuuaugcugga

SEQ ID NO: 1380878 - RNA, 23 nt, Human
uucagcaagauagucauauauca

SEQ ID NO: 1380879 - RNA, 20 nt, Human
uucaggaaaaugcaagaauu

SEQ ID NO: 1380880 - RNA, 23 nt, Human
uucauuccccuauuaccgccucc

SEQ ID NO: 1380881 - RNA, 24 nt, Human
uuccaacauauacaaucuauugua

SEQ ID NO: 1380882 - RNA, 22 nt, Human
uuccuggucacuaucaugccuu

SEQ ID NO: 1380883 - RNA, 19 nt, Human
uugcuguguauuccuuccu

SEQ ID NO: 1380884 - RNA, 24 nt, Human
uugggcuguguuuuucagcuucau

SEQ ID NO: 1380885 - RNA, 20 nt, Human
uuggugaccuuaggaugaag

SEQ ID NO: 1380886 - RNA, 20 nt, Human
uuuaaaaugaacacuucagg

SEQ ID NO: 1380887 - RNA, 23 nt, Human
uuuauguucuucucuaaacuagu

SEQ ID NO: 1380888 - RNA, 21 nt, Human
uuuguugaaaggcaguccaga

SEQ ID NO: 1380889 - RNA, 20 nt, Human
uuuuaugcuggauuuuccuc

SEQ ID NO: 1380890 - RNA, 18 nt, Human
uuuucagcuucaucaggu

SEQ ID NO: 1380891 - RNA, 19 nt, Human
gcugagcacacaggaaacc

SEQ ID NO: 1380892 - RNA, 19 nt, Human
gucuccuuggcuaguaguu

SEQ ID NO: 1380893 - RNA, 21 nt, Human
uagcugaugugcaauugaggc

SEQ ID NO: 1380894 - RNA, 26 nt, Human
ucuaaaagccuuauuuccucaucucu

SEQ ID NO: 1380895 - RNA, 23 nt, Human
ucucucgucauuuuguuugcaaa

SEQ ID NO: 1380896 - RNA, 23 nt, Human
ugaacgaucauuauuuaguccca

SEQ ID NO: 1380897 - RNA, 19 nt, Human
ugaccaaaauggauccuac

SEQ ID NO: 1380898 - RNA, 23 nt, Human
uuugacagaugaccaaaauggau

SEQ ID NO: 1380899 - RNA, 20 nt, Human
uuugcaaacugucuaaaagc

SEQ ID NO: 1380900 - RNA, 27 nt, Human
aacacucugccuggccaggcccugcua

SEQ ID NO: 1380901 - RNA, 21 nt, Human
aacccugcucaagcacguggu

SEQ ID NO: 1380902 - RNA, 19 nt, Human
accucuaggucuccauccc

SEQ ID NO: 1380903 - RNA, 18 nt, Human
caaagcccaacaccaagg

SEQ ID NO: 1380904 - RNA, 18 nt, Human
caaggggccccucuggga

SEQ ID NO: 1380905 - RNA, 19 nt, Human
caccgccuuuccagcugcc

SEQ ID NO: 1380906 - RNA, 21 nt, Human
caggcccugcuaaggggcaga

SEQ ID NO: 1380907 - RNA, 24 nt, Human
caguccacccaucuuugguggccu

SEQ ID NO: 1380908 - RNA, 22 nt, Human
cccaccgacgaaagggagcagg

SEQ ID NO: 1380909 - RNA, 19 nt, Human
ccccaccucuaggucucca

SEQ ID NO: 1380910 - RNA, 22 nt, Human
cccccacaggucuaggccccug

SEQ ID NO: 1380911 - RNA, 20 nt, Human
cccccaccucuaggucucca

SEQ ID NO: 1380912 - RNA, 19 nt, Human
ccccucugggagguggccu

SEQ ID NO: 1380913 - RNA, 21 nt, Human
ccccucugggagguggccuaa

SEQ ID NO: 1380914 - RNA, 22 nt, Human
ccccuggggcucaggccuccug

SEQ ID NO: 1380915 - RNA, 21 nt, Human
cccgcugcccccacaggucua

SEQ ID NO: 1380916 - RNA, 19 nt, Human
ccucuaggucuccaucccc

SEQ ID NO: 1380917 - RNA, 22 nt, Human
ccucugggagguggccuaaccc

SEQ ID NO: 1380918 - RNA, 21 nt, Human
ccugcaccgccuuuccagcug

SEQ ID NO: 1380919 - RNA, 20 nt, Human
cggcgggugcugaagcgcgg

SEQ ID NO: 1380920 - RNA, 20 nt, Human
cuaacccugcucaagcacgu

SEQ ID NO: 1380921 - RNA, 22 nt, Human
cuccuuugacccugggccaggg

SEQ ID NO: 1380922 - RNA, 23 nt, Human
cucuccuuugacccugggccagg

SEQ ID NO: 1380923 - RNA, 24 nt, Human
cugaagcgcggccgaccaagccca

SEQ ID NO: 1380924 - RNA, 21 nt, Human
cugcaccgccuuuccagcugc

SEQ ID NO: 1380925 - RNA, 23 nt, Human
cuuccucccuggggcucgggugg

SEQ ID NO: 1380926 - RNA, 19 nt, Human
cuuggguaagccccggcuc

SEQ ID NO: 1380927 - RNA, 22 nt, Human
gaaggaauggaggcucaggccu

SEQ ID NO: 1380928 - RNA, 23 nt, Human
gaagggccuccauuccuucuguu

SEQ ID NO: 1380929 - RNA, 22 nt, Human
gacccugcggccagaggcuugg

SEQ ID NO: 1380930 - RNA, 23 nt, Human
gaggcagcagugccugggggugg

SEQ ID NO: 1380931 - RNA, 19 nt, Human
gcaccgccuuuccagcugc

SEQ ID NO: 1380932 - RNA, 18 nt, Human
gccaucucuccuuugacc

SEQ ID NO: 1380933 - RNA, 22 nt, Human
gcccccaccucuaggucuccau

SEQ ID NO: 1380934 - RNA, 19 nt, Human
gccuccaguccacccaucu

SEQ ID NO: 1380935 - RNA, 24 nt, Human
gccuccauuccuucuguuccccau

SEQ ID NO: 1380936 - RNA, 18 nt, Human
gccugcaccgccuuucca

SEQ ID NO: 1380937 - RNA, 25 nt, Human
ggccagaggcuuggccuccugccag

SEQ ID NO: 1380938 - RNA, 21 nt, Human
gggcagagacugaaggcuggg

SEQ ID NO: 1380939 - RNA, 18 nt, Human
ggggcucggguggccuca

SEQ ID NO: 1380940 - RNA, 18 nt, Human
gugggcuuggccaggcgg

SEQ ID NO: 1380941 - RNA, 19 nt, Human
gugguccuggagaagccca

SEQ ID NO: 1380942 - RNA, 18 nt, Human
ucaagcacgugguccugg

SEQ ID NO: 1380943 - RNA, 25 nt, Human
ucaguggccaaggcaggccgggguc

SEQ ID NO: 1380944 - RNA, 19 nt, Human
ucccggacccauggggccc

SEQ ID NO: 1380945 - RNA, 19 nt, Human
ucccggacccauggggccc

SEQ ID NO: 1380946 - RNA, 18 nt, Human
ucccuggggcucgggugg

SEQ ID NO: 1380947 - RNA, 19 nt, Human
ucccuggggcucggguggc

SEQ ID NO: 1380948 - RNA, 22 nt, Human
ucccuggggcucggguggccuc

SEQ ID NO: 1380949 - RNA, 18 nt, Human
uccucccuggggcucggg

SEQ ID NO: 1380950 - RNA, 22 nt, Human
ugaagcgcggccgaccaagccc

SEQ ID NO: 1380951 - RNA, 21 nt, Human
ugacccugggccaggggcugg

SEQ ID NO: 1380952 - RNA, 23 nt, Human
ugacccugggccaggggcugggg

SEQ ID NO: 1380953 - RNA, 20 nt, Human
ugaggugcaugcaugcgggg

SEQ ID NO: 1380954 - RNA, 21 nt, Human
ugcaaagcccaacaccaaggg

SEQ ID NO: 1380955 - RNA, 19 nt, Human
ugcaugcgggggaggggcu

SEQ ID NO: 1380956 - RNA, 20 nt, Human
uggccaggcccugcuaaggg

SEQ ID NO: 1380957 - RNA, 19 nt, Human
uggcgacagggggacaggg

SEQ ID NO: 1380958 - RNA, 18 nt, Human
ugggagggagagcagugg

SEQ ID NO: 1380959 - RNA, 21 nt, Human
ugggccaagggaagccuucag

SEQ ID NO: 1380960 - RNA, 21 nt, Human
uggggaaggaauggaggcuca

SEQ ID NO: 1380961 - RNA, 20 nt, Human
ugggggugggcugcgaucug

SEQ ID NO: 1380962 - RNA, 27 nt, Human
uuuccagcugccuccaguccacccauc

SEQ ID NO: 1380963 - RNA, 19 nt, Human
uuugacccugggccagggg

SEQ ID NO: 1380964 - RNA, 20 nt, Human
uuugacccugggccaggggc

SEQ ID NO: 1380965 - RNA, 20 nt, Human
caaagugggaucagugaauc

SEQ ID NO: 1380966 - RNA, 23 nt, Human
caaaugauuuuuuucacagccca

SEQ ID NO: 1380967 - RNA, 25 nt, Human
ccagcaauucuggcuggugauguca

SEQ ID NO: 1380968 - RNA, 20 nt, Human
gcuggugaugucacaaugac

SEQ ID NO: 1380969 - RNA, 21 nt, Human
guccuuguaucacgacaucag

SEQ ID NO: 1380970 - RNA, 24 nt, Human
uaaauaaauguacagccccccaag

SEQ ID NO: 1380971 - RNA, 25 nt, Human
uaaauaaauguacagccccccaaga

SEQ ID NO: 1380972 - RNA, 19 nt, Human
aaagugcuaggauugcugg

SEQ ID NO: 1380973 - RNA, 24 nt, Human
aaagugcuaggauugcuggcauga

SEQ ID NO: 1380974 - RNA, 22 nt, Human
aagcagccaccugugcccucug

SEQ ID NO: 1380975 - RNA, 25 nt, Human
aagcgauccucccacuucagccucc

SEQ ID NO: 1380976 - RNA, 20 nt, Human
aaggcaguccuaaaccuuga

SEQ ID NO: 1380977 - RNA, 20 nt, Human
aaguagcugggacuagaggc

SEQ ID NO: 1380978 - RNA, 24 nt, Human
aaguagcugggacuagaggcacgc

SEQ ID NO: 1380979 - RNA, 26 nt, Human
aagugcuaggauugcuggcaugagcc

SEQ ID NO: 1380980 - RNA, 23 nt, Human
acaacuuccagaggcccaauccu

SEQ ID NO: 1380981 - RNA, 22 nt, Human
acagcaaaggcaggcucccaaa

SEQ ID NO: 1380982 - RNA, 23 nt, Human
acccaggcuggagugcaguggug

SEQ ID NO: 1380983 - RNA, 23 nt, Human
accucagccucccaaagugcuag

SEQ ID NO: 1380984 - RNA, 22 nt, Human
accugugcccucugggcucucc

SEQ ID NO: 1380985 - RNA, 18 nt, Human
acucugucacccaggcug

SEQ ID NO: 1380986 - RNA, 24 nt, Human
acucugucacccaggcuggagugc

SEQ ID NO: 1380987 - RNA, 23 nt, Human
acuucagccucccaaguagcugg

SEQ ID NO: 1380988 - RNA, 22 nt, Human
agacagagcucuuggcuuugua

SEQ ID NO: 1380989 - RNA, 21 nt, Human
agagugaggaacucagcugau

SEQ ID NO: 1380990 - RNA, 19 nt, Human
aggaauccgugggccaggc

SEQ ID NO: 1380991 - RNA, 18 nt, Human
aggcaaggagucagaccu

SEQ ID NO: 1380992 - RNA, 18 nt, Human
aggcacgcaccaccaucc

SEQ ID NO: 1380993 - RNA, 19 nt, Human
agucaggaggcaaggucag

SEQ ID NO: 1380994 - RNA, 20 nt, Human
agugaggaacucagcugaug

SEQ ID NO: 1380995 - RNA, 20 nt, Human
agugcaguggugcuaucaug

SEQ ID NO: 1380996 - RNA, 22 nt, Human
aucccuccccccuccucccacc

SEQ ID NO: 1380997 - RNA, 21 nt, Human
auguucuagaaggaauccgug

SEQ ID NO: 1380998 - RNA, 24 nt, Human
caaacuccugggcucaagcaaccu

SEQ ID NO: 1380999 - RNA, 24 nt, Human
caaagugcuaggauugcuggcaug

SEQ ID NO: 1381000 - RNA, 27 nt, Human
caagcgauccucccacuucagccuccc

SEQ ID NO: 1381001 - RNA, 23 nt, Human
caaguagcugggacuagaggcac

SEQ ID NO: 1381002 - RNA, 22 nt, Human
cacaacaguccccagaguguga

SEQ ID NO: 1381003 - RNA, 20 nt, Human
cacaguggaugccuacugga

SEQ ID NO: 1381004 - RNA, 21 nt, Human
cacccaggcuggagugcagug

SEQ ID NO: 1381005 - RNA, 19 nt, Human
caccccacaacagucccca

SEQ ID NO: 1381006 - RNA, 21 nt, Human
caccccacaacaguccccaga

SEQ ID NO: 1381007 - RNA, 18 nt, Human
cacgcuucccagcagggc

SEQ ID NO: 1381008 - RNA, 23 nt, Human
cacucugucacccaggcuggagu

SEQ ID NO: 1381009 - RNA, 24 nt, Human
cacucugucacccaggcuggagug

SEQ ID NO: 1381010 - RNA, 18 nt, Human
cacugcacccagccucca

SEQ ID NO: 1381011 - RNA, 20 nt, Human
cacugcacccagccuccagc

SEQ ID NO: 1381012 - RNA, 22 nt, Human
cacugcacccagccuccagcuu

SEQ ID NO: 1381013 - RNA, 23 nt, Human
cacugcacccagccuccagcuuu

SEQ ID NO: 1381014 - RNA, 22 nt, Human
cagagguccuucugucuagcuu

SEQ ID NO: 1381015 - RNA, 24 nt, Human
cauguugccucgccuggucucaaa

SEQ ID NO: 1381016 - RNA, 18 nt, Human
cauuagguauaccuccca

SEQ ID NO: 1381017 - RNA, 19 nt, Human
ccaaagugcuaggauugcu

SEQ ID NO: 1381018 - RNA, 24 nt, Human
ccaaagugcuaggauugcuggcau

SEQ ID NO: 1381019 - RNA, 22 nt, Human
ccaaguagcugggacuagaggc

SEQ ID NO: 1381020 - RNA, 19 nt, Human
cccaaguagcugggacuag

SEQ ID NO: 1381021 - RNA, 19 nt, Human
cccaaugcuaucccucccc

SEQ ID NO: 1381022 - RNA, 19 nt, Human
ccccccuccucccacccca

SEQ ID NO: 1381023 - RNA, 21 nt, Human
ccccuaaacuggcuuagcagg

SEQ ID NO: 1381024 - RNA, 26 nt, Human
ccccuccucccaccccacaacagucc

SEQ ID NO: 1381025 - RNA, 19 nt, Human
ccucccaaugcuaucccuc

SEQ ID NO: 1381026 - RNA, 19 nt, Human
ccucccaccccacaacagu

SEQ ID NO: 1381027 - RNA, 26 nt, Human
ccucccacuucagccucccaaguagc

SEQ ID NO: 1381028 - RNA, 20 nt, Human
ccucgggaaagaacagggag

SEQ ID NO: 1381029 - RNA, 21 nt, Human
ccugcucaccucagccuccca

SEQ ID NO: 1381030 - RNA, 18 nt, Human
ccugggcucaagcaaccu

SEQ ID NO: 1381031 - RNA, 20 nt, Human
ccugggcucaagcgauccuc

SEQ ID NO: 1381032 - RNA, 21 nt, Human
ccugggggugaugagcuagug

SEQ ID NO: 1381033 - RNA, 21 nt, Human
ccugugcccucugggcucucc

SEQ ID NO: 1381034 - RNA, 19 nt, Human
cgaggccuggugacuuaaa

SEQ ID NO: 1381035 - RNA, 19 nt, Human
cuaagcagccaccugugcc

SEQ ID NO: 1381036 - RNA, 24 nt, Human
cuaugagugagaauaugcgguguu

SEQ ID NO: 1381037 - RNA, 24 nt, Human
cucaagcgauccucccacuucagc

SEQ ID NO: 1381038 - RNA, 24 nt, Human
cucacucugucacccaggcuggag

SEQ ID NO: 1381039 - RNA, 21 nt, Human
cucacugcagcuuugaacucc

SEQ ID NO: 1381040 - RNA, 24 nt, Human
cucacugcagcuuugaacuccugg

SEQ ID NO: 1381041 - RNA, 22 nt, Human
cuccauggccggccuuucugcc

SEQ ID NO: 1381042 - RNA, 19 nt, Human
cucccaccccacaacaguc

SEQ ID NO: 1381043 - RNA, 19 nt, Human
cuccugggcucaagcaacc

SEQ ID NO: 1381044 - RNA, 23 nt, Human
cuccugggcucaagcgauccucc

SEQ ID NO: 1381045 - RNA, 22 nt, Human
cucuuugaaaacuuagcccaga

SEQ ID NO: 1381046 - RNA, 24 nt, Human
cugcacccacuaacucgucaucua

SEQ ID NO: 1381047 - RNA, 25 nt, Human
cugccaauaugugcugauuauggaa

SEQ ID NO: 1381048 - RNA, 25 nt, Human
cuucagccucccaaguagcugggac

SEQ ID NO: 1381049 - RNA, 23 nt, Human
cuuugaacuccugggcucaagcg

SEQ ID NO: 1381050 - RNA, 18 nt, Human
gagaacaacgaggccugg

SEQ ID NO: 1381051 - RNA, 24 nt, Human
gagaggggaucuugccauguugcc

SEQ ID NO: 1381052 - RNA, 18 nt, Human
gaggacccuggcugaggu

SEQ ID NO: 1381053 - RNA, 21 nt, Human
gagggagacagagcucuuggc

SEQ ID NO: 1381054 - RNA, 22 nt, Human
gaucucauuguucaauucccac

SEQ ID NO: 1381055 - RNA, 23 nt, Human
gauugcuggcaugagccacugca

SEQ ID NO: 1381056 - RNA, 21 nt, Human
gccuagucaagaagagggccc

SEQ ID NO: 1381057 - RNA, 19 nt, Human
gcuggagugcaguggugcu

SEQ ID NO: 1381058 - RNA, 22 nt, Human
ggauugcuggcaugagccacug

SEQ ID NO: 1381059 - RNA, 20 nt, Human
ggcaugagccacugcaccca

SEQ ID NO: 1381060 - RNA, 27 nt, Human
ggccacagagguccuucugucuagcuu

SEQ ID NO: 1381061 - RNA, 21 nt, Human
guagagaggggaucuugccau

SEQ ID NO: 1381062 - RNA, 24 nt, Human
gugcaguggugcuaucaugacuca

SEQ ID NO: 1381063 - RNA, 18 nt, Human
uaaaacaggccaagggug

SEQ ID NO: 1381064 - RNA, 21 nt, Human
uaagagaaauugcacugggca

SEQ ID NO: 1381065 - RNA, 19 nt, Human
uaagcagccaccugugccc

SEQ ID NO: 1381066 - RNA, 20 nt, Human
uaagcagccaccugugcccu

SEQ ID NO: 1381067 - RNA, 22 nt, Human
uagagaggggaucuugccaugu

SEQ ID NO: 1381068 - RNA, 22 nt, Human
uaggauugcuggcaugagccac

SEQ ID NO: 1381069 - RNA, 24 nt, Human
uaggauugcuggcaugagccacug

SEQ ID NO: 1381070 - RNA, 24 nt, Human
uaguuuacugagaaugauagugac

SEQ ID NO: 1381071 - RNA, 19 nt, Human
ucaagcccauguuggccgg

SEQ ID NO: 1381072 - RNA, 18 nt, Human
ucaagggucgggggcauu

SEQ ID NO: 1381073 - RNA, 24 nt, Human
ucacccaggcuggagugcaguggu

SEQ ID NO: 1381074 - RNA, 24 nt, Human
ucaccucagccucccaaagugcua

SEQ ID NO: 1381075 - RNA, 24 nt, Human
ucacucugucacccaggcuggagu

SEQ ID NO: 1381076 - RNA, 24 nt, Human
ucacugcagcuuugaacuccuggg

SEQ ID NO: 1381077 - RNA, 18 nt, Human
ucagccucccaaguagcu

SEQ ID NO: 1381078 - RNA, 20 nt, Human
ucagccucccaaguagcugg

SEQ ID NO: 1381079 - RNA, 20 nt, Human
ucccaaagugcuaggauugc

SEQ ID NO: 1381080 - RNA, 24 nt, Human
ucccaaagugcuaggauugcuggc

SEQ ID NO: 1381081 - RNA, 24 nt, Human
ucccaaguagcugggacuagaggc

SEQ ID NO: 1381082 - RNA, 18 nt, Human
ucccaaugcuaucccucc

SEQ ID NO: 1381083 - RNA, 21 nt, Human
ucccaaugcuaucccuccccc

SEQ ID NO: 1381084 - RNA, 25 nt, Human
ucccaccccacaacaguccccagaa

SEQ ID NO: 1381085 - RNA, 26 nt, Human
ucccaccccacaacaguccccagaag

SEQ ID NO: 1381086 - RNA, 18 nt, Human
uccccccuccucccaccc

SEQ ID NO: 1381087 - RNA, 23 nt, Human
uccccccuccucccaccccacaa

SEQ ID NO: 1381088 - RNA, 18 nt, Human
ucccuccccccuccuccc

SEQ ID NO: 1381089 - RNA, 23 nt, Human
uccucagagcacucagagguggc

SEQ ID NO: 1381090 - RNA, 18 nt, Human
uccucccaccccacaaca

SEQ ID NO: 1381091 - RNA, 19 nt, Human
uccugggcucaagcaaccu

SEQ ID NO: 1381092 - RNA, 21 nt, Human
uccugggcucaagcgauccuc

SEQ ID NO: 1381093 - RNA, 24 nt, Human
uccugggcucaagcgauccuccca

SEQ ID NO: 1381094 - RNA, 21 nt, Human
ucgccuggucucaaacuccug

SEQ ID NO: 1381095 - RNA, 23 nt, Human
ucucaaacuccugggcucaagca

SEQ ID NO: 1381096 - RNA, 23 nt, Human
ucucacucugucacccaggcugg

SEQ ID NO: 1381097 - RNA, 24 nt, Human
ucucacucugucacccaggcugga

SEQ ID NO: 1381098 - RNA, 26 nt, Human
ucucacucugucacccaggcuggagu

SEQ ID NO: 1381099 - RNA, 27 nt, Human
ucucacucugucacccaggcuggagug

SEQ ID NO: 1381100 - RNA, 20 nt, Human
ucuccagcuugggaggggcc

SEQ ID NO: 1381101 - RNA, 24 nt, Human
ucugucacccaggcuggagugcag

SEQ ID NO: 1381102 - RNA, 23 nt, Human
ucuugccauguugccucgccugg

SEQ ID NO: 1381103 - RNA, 20 nt, Human
ugaaaacuuagcccagaaau

SEQ ID NO: 1381104 - RNA, 25 nt, Human
ugaacuccugggcucaagcgauccu

SEQ ID NO: 1381105 - RNA, 21 nt, Human
ugagaacaacgaggccuggug

SEQ ID NO: 1381106 - RNA, 22 nt, Human
ugaggaacucagcugauggaaa

SEQ ID NO: 1381107 - RNA, 19 nt, Human
ugagugagaauaugcggug

SEQ ID NO: 1381108 - RNA, 24 nt, Human
ugagugagaauaugcgguguuugg

SEQ ID NO: 1381109 - RNA, 21 nt, Human
ugcagcuuugaacuccugggc

SEQ ID NO: 1381110 - RNA, 24 nt, Human
ugccauguugccucgccuggucuc

SEQ ID NO: 1381111 - RNA, 19 nt, Human
ugccuacuggagaggggcu

SEQ ID NO: 1381112 - RNA, 23 nt, Human
ugccucgggaaagaacagggagu

SEQ ID NO: 1381113 - RNA, 19 nt, Human
ugcuggcaugagccacugc

SEQ ID NO: 1381114 - RNA, 18 nt, Human
uggaaaauuaaaaagagg

SEQ ID NO: 1381115 - RNA, 23 nt, Human
uggagugcaguggugcuaucaug

SEQ ID NO: 1381116 - RNA, 28 nt, Human
uggagugcaguggugcuauccuagcacg

SEQ ID NO: 1381117 - RNA, 28 nt, Human
uggagugcaguggugcuauggcucuagc

SEQ ID NO: 1381118 - RNA, 18 nt, Human
uggccggaggcuagaggu

SEQ ID NO: 1381119 - RNA, 18 nt, Human
uggccgugagaacaacga

SEQ ID NO: 1381120 - RNA, 18 nt, Human
uggcuuagcaggauucuc

SEQ ID NO: 1381121 - RNA, 24 nt, Human
ugggacuagaggcacgcaccacca

SEQ ID NO: 1381122 - RNA, 23 nt, Human
ugggagggagacagagcucuugg

SEQ ID NO: 1381123 - RNA, 24 nt, Human
ugguagagaggggaucuugccaug

SEQ ID NO: 1381124 - RNA, 23 nt, Human
uguagugagaacaugaauccauu

SEQ ID NO: 1381125 - RNA, 23 nt, Human
ugugcagguuaguuacauaugua

SEQ ID NO: 1381126 - RNA, 20 nt, Human
uguucuagaaggaauccgug

SEQ ID NO: 1381127 - RNA, 24 nt, Human
uuacggccgaaaggcagagugagg

SEQ ID NO: 1381128 - RNA, 22 nt, Human
uuacugagaaugauagugacag

SEQ ID NO: 1381129 - RNA, 20 nt, Human
uuccagaggcccaauccugg

SEQ ID NO: 1381130 - RNA, 23 nt, Human
uugguagagaggggaucuugcca

SEQ ID NO: 1381131 - RNA, 18 nt, Human
uuggucaaggagggaguc

SEQ ID NO: 1381132 - RNA, 22 nt, Human
uuuauacuuuaaguuuuagggu

SEQ ID NO: 1381133 - RNA, 23 nt, Human
uuuuuuuuuuuaggcagggucuc

SEQ ID NO: 1381134 - RNA, 25 nt, Human
uuuuuuuuuuuuaggcagggucuca

SEQ ID NO: 1381135 - RNA, 21 nt, Human
uuuuuuuuuuuuuaggcaggg

SEQ ID NO: 1381136 - RNA, 20 nt, Human
aaaaaugccugcugaaccac

SEQ ID NO: 1381137 - RNA, 20 nt, Human
aaaagcaaguuuauuaagaa

SEQ ID NO: 1381138 - RNA, 25 nt, Human
aaaccaaacaaaacagcaaggagaa

SEQ ID NO: 1381139 - RNA, 21 nt, Human
aaacggagacagcaaccaaga

SEQ ID NO: 1381140 - RNA, 24 nt, Human
aaagugcugggauuacagguguga

SEQ ID NO: 1381141 - RNA, 19 nt, Human
aacaaaacacaaccacauc

SEQ ID NO: 1381142 - RNA, 22 nt, Human
aacaaaacaugcagauccuccc

SEQ ID NO: 1381143 - RNA, 23 nt, Human
aacaaaacaugcagauccuccca

SEQ ID NO: 1381144 - RNA, 19 nt, Human
aacacagagacaacaaaac

SEQ ID NO: 1381145 - RNA, 23 nt, Human
aacagcaaggagaaaaguccccc

SEQ ID NO: 1381146 - RNA, 21 nt, Human
aaccaaacaaaacagcaagga

SEQ ID NO: 1381147 - RNA, 20 nt, Human
aacggagacagcaaccaaga

SEQ ID NO: 1381148 - RNA, 18 nt, Human
aacguauccacccuaggu

SEQ ID NO: 1381149 - RNA, 19 nt, Human
aagaagcugggauuacaga

SEQ ID NO: 1381150 - RNA, 22 nt, Human
aagaagcugggauuacagaugu

SEQ ID NO: 1381151 - RNA, 23 nt, Human
aagcaaacggacagaaaucggga

SEQ ID NO: 1381152 - RNA, 26 nt, Human
aagcaauucuccugccucagccgccc

SEQ ID NO: 1381153 - RNA, 24 nt, Human
aagggguuucaccaugcuggccag

SEQ ID NO: 1381154 - RNA, 18 nt, Human
aagugcugggauuacagg

SEQ ID NO: 1381155 - RNA, 19 nt, Human
aagugcugggauuacaggu

SEQ ID NO: 1381156 - RNA, 26 nt, Human
aagugcugggauuacaggugugagcc

SEQ ID NO: 1381157 - RNA, 25 nt, Human
acaacacagagacaacaaaacaugc

SEQ ID NO: 1381158 - RNA, 21 nt, Human
acagagaagggcguuccugaa

SEQ ID NO: 1381159 - RNA, 24 nt, Human
acaggaaaagggccccgauccaga

SEQ ID NO: 1381160 - RNA, 22 nt, Human
accacaucuaucgaaucuuacu

SEQ ID NO: 1381161 - RNA, 22 nt, Human
accaugcuggccaggcuggucu

SEQ ID NO: 1381162 - RNA, 19 nt, Human
acccaggcuggagugcaau

SEQ ID NO: 1381163 - RNA, 23 nt, Human
acgaaccuucagagcugacagaa

SEQ ID NO: 1381164 - RNA, 20 nt, Human
acgggguuucaacacguugg

SEQ ID NO: 1381165 - RNA, 24 nt, Human
acgggguuucaacacguuggccag

SEQ ID NO: 1381166 - RNA, 19 nt, Human
acggguugcgagccaauac

SEQ ID NO: 1381167 - RNA, 23 nt, Human
acugaaacggagacagcaaccaa

SEQ ID NO: 1381168 - RNA, 21 nt, Human
acugcagugcugcagucuacu

SEQ ID NO: 1381169 - RNA, 22 nt, Human
agaagggcguuccugaaacuaa

SEQ ID NO: 1381170 - RNA, 21 nt, Human
agaagggguuucaccaugcug

SEQ ID NO: 1381171 - RNA, 18 nt, Human
agauaaaccacaacaugg

SEQ ID NO: 1381172 - RNA, 21 nt, Human
agcaauuuuagagccggaucc

SEQ ID NO: 1381173 - RNA, 25 nt, Human
agcacagcagcaacaaaacacaacc

SEQ ID NO: 1381174 - RNA, 18 nt, Human
aggaggacgaggcagacu

SEQ ID NO: 1381175 - RNA, 24 nt, Human
agggguuucaccaugcuggccagg

SEQ ID NO: 1381176 - RNA, 24 nt, Human
aggugaucugccugccucggccuc

SEQ ID NO: 1381177 - RNA, 23 nt, Human
aguaaaguggugaaagaacagcu

SEQ ID NO: 1381178 - RNA, 22 nt, Human
aguagagaagggguuucaccau

SEQ ID NO: 1381179 - RNA, 21 nt, Human
aguaguacucggugggcuaag

SEQ ID NO: 1381180 - RNA, 24 nt, Human
agugauccaccccccucagccucc

SEQ ID NO: 1381181 - RNA, 19 nt, Human
agugcaguggugcaaucuc

SEQ ID NO: 1381182 - RNA, 21 nt, Human
agugcaguggugcaaucucag

SEQ ID NO: 1381183 - RNA, 19 nt, Human
aguugauuucucaaacuca

SEQ ID NO: 1381184 - RNA, 21 nt, Human
auguacucucacagugcccuc

SEQ ID NO: 1381185 - RNA, 24 nt, Human
auguuuguauuuuuaguagagacg

SEQ ID NO: 1381186 - RNA, 23 nt, Human
caaaacaugcagauccucccaag

SEQ ID NO: 1381187 - RNA, 21 nt, Human
caaaaccaaacaaaacagcaa

SEQ ID NO: 1381188 - RNA, 26 nt, Human
caaaauaaaugaagaggauuuagaug

SEQ ID NO: 1381189 - RNA, 25 nt, Human
caaaccagacggagaaaagggaaca

SEQ ID NO: 1381190 - RNA, 20 nt, Human
caaagcaaacacgguuugcc

SEQ ID NO: 1381191 - RNA, 19 nt, Human
caaagucagucuacugacu

SEQ ID NO: 1381192 - RNA, 24 nt, Human
caaagugcugggauuacaggugug

SEQ ID NO: 1381193 - RNA, 24 nt, Human
caacacguuggccaggauggucuc

SEQ ID NO: 1381194 - RNA, 21 nt, Human
caaccaagacaaggaggacga

SEQ ID NO: 1381195 - RNA, 22 nt, Human
caagcaauucuccugccucagc

SEQ ID NO: 1381196 - RNA, 27 nt, Human
caagcaauucuccugccucagccgccc

SEQ ID NO: 1381197 - RNA, 19 nt, Human
caagugauccaccccccuc

SEQ ID NO: 1381198 - RNA, 21 nt, Human
caauggaaaaaguagacugga

SEQ ID NO: 1381199 - RNA, 22 nt, Human
cacaacauggacuuugaaaaaa

SEQ ID NO: 1381200 - RNA, 19 nt, Human
cacacucagcacagcagca

SEQ ID NO: 1381201 - RNA, 20 nt, Human
cacacucagcacagcagcaa

SEQ ID NO: 1381202 - RNA, 23 nt, Human
cacagagacaacaaaacaugcag

SEQ ID NO: 1381203 - RNA, 21 nt, Human
cacagcagcaacaaaacacaa

SEQ ID NO: 1381204 - RNA, 18 nt, Human
cacagugcccucuucccg

SEQ ID NO: 1381205 - RNA, 24 nt, Human
caccauccccagcuaauuuuugua

SEQ ID NO: 1381206 - RNA, 21 nt, Human
caccaugcuggccaggcuggu

SEQ ID NO: 1381207 - RNA, 23 nt, Human
caccaugcuggccaggcuggucu

SEQ ID NO: 1381208 - RNA, 27 nt, Human
caccaugcuggccaggcuggucuugaa

SEQ ID NO: 1381209 - RNA, 19 nt, Human
cacccaaaaaugccugcug

SEQ ID NO: 1381210 - RNA, 18 nt, Human
caccccccucagccuccc

SEQ ID NO: 1381211 - RNA, 21 nt, Human
caccccccucagccucccaaa

SEQ ID NO: 1381212 - RNA, 18 nt, Human
cacuguacaacacagaga

SEQ ID NO: 1381213 - RNA, 23 nt, Human
cacuguacaacacagagacaaca

SEQ ID NO: 1381214 - RNA, 24 nt, Human
cacuguacaacacagagacaacaa

SEQ ID NO: 1381215 - RNA, 24 nt, Human
cagcaacaaaacacaaccacaucu

SEQ ID NO: 1381216 - RNA, 20 nt, Human
cagcaaggagaaaagucccc

SEQ ID NO: 1381217 - RNA, 23 nt, Human
cagcagcaacaaaacacaaccac

SEQ ID NO: 1381218 - RNA, 24 nt, Human
cagcagcaacaaaacacaaccaca

SEQ ID NO: 1381219 - RNA, 19 nt, Human
cagcuacuccacagacaga

SEQ ID NO: 1381220 - RNA, 22 nt, Human
caggugaucugccugccucggc

SEQ ID NO: 1381221 - RNA, 24 nt, Human
caugcuggccaggcuggucuugaa

SEQ ID NO: 1381222 - RNA, 21 nt, Human
ccaaagugcugggauuacagg

SEQ ID NO: 1381223 - RNA, 21 nt, Human
ccaaagugcugggauuacagg

SEQ ID NO: 1381224 - RNA, 24 nt, Human
ccaaagugcugggauuacaggugu

SEQ ID NO: 1381225 - RNA, 24 nt, Human
ccaagaagcugggauuacagaugu

SEQ ID NO: 1381226 - RNA, 23 nt, Human
cccaaagucagucuacugacuac

SEQ ID NO: 1381227 - RNA, 20 nt, Human
cccaacacuuccccaaagca

SEQ ID NO: 1381228 - RNA, 19 nt, Human
cccaagaagcugggauuac

SEQ ID NO: 1381229 - RNA, 22 nt, Human
cccaagaagcugggauuacaga

SEQ ID NO: 1381230 - RNA, 24 nt, Human
cccaaguaggugagauuacaggca

SEQ ID NO: 1381231 - RNA, 21 nt, Human
cccaguguuucacaagcaaac

SEQ ID NO: 1381232 - RNA, 20 nt, Human
ccccaacacuuccccaaagc

SEQ ID NO: 1381233 - RNA, 24 nt, Human
ccccucagccucccaaagugcugg

SEQ ID NO: 1381234 - RNA, 21 nt, Human
cccgaauccaagaaaagaaag

SEQ ID NO: 1381235 - RNA, 21 nt, Human
cccguaagucccggccucauu

SEQ ID NO: 1381236 - RNA, 19 nt, Human
cccucacucaaaauggggu

SEQ ID NO: 1381237 - RNA, 22 nt, Human
ccgcagaaaacgaaugcaacaa

SEQ ID NO: 1381238 - RNA, 24 nt, Human
ccgcccaaguaggugagauuacag

SEQ ID NO: 1381239 - RNA, 21 nt, Human
ccgcggugcaaaauaaaagca

SEQ ID NO: 1381240 - RNA, 24 nt, Human
ccucauggguucaagcaauucucc

SEQ ID NO: 1381241 - RNA, 23 nt, Human
ccugaccucaagugauccacccc

SEQ ID NO: 1381242 - RNA, 24 nt, Human
ccugaccucaagugauccaccccc

SEQ ID NO: 1381243 - RNA, 21 nt, Human
ccugauuucaggugaucugcc

SEQ ID NO: 1381244 - RNA, 18 nt, Human
cgagccaauaccucaucu

SEQ ID NO: 1381245 - RNA, 24 nt, Human
cgcucugucacccaggcuggagug

SEQ ID NO: 1381246 - RNA, 20 nt, Human
cuaauuuuuguauuuuuaga

SEQ ID NO: 1381247 - RNA, 24 nt, Human
cucgcucugucacccaggcuggag

SEQ ID NO: 1381248 - RNA, 24 nt, Human
cugacagucauacuacauaugacu

SEQ ID NO: 1381249 - RNA, 23 nt, Human
cugccucggccucccaaagugcu

SEQ ID NO: 1381250 - RNA, 18 nt, Human
cuuccccaaagcacuaua

SEQ ID NO: 1381251 - RNA, 21 nt, Human
gaaugcaggcccguaaguccc

SEQ ID NO: 1381252 - RNA, 24 nt, Human
gaccucaagugauccaccccccuc

SEQ ID NO: 1381253 - RNA, 18 nt, Human
gauuacagaugucugcca

SEQ ID NO: 1381254 - RNA, 18 nt, Human
gauuacaggugugagcca

SEQ ID NO: 1381255 - RNA, 22 nt, Human
gauuacaggugugagccaccgc

SEQ ID NO: 1381256 - RNA, 23 nt, Human
gauuacaggugugagccaccgca

SEQ ID NO: 1381257 - RNA, 21 nt, Human
gcaaaaccaaacaaaacagca

SEQ ID NO: 1381258 - RNA, 22 nt, Human
gcaacuuccaccucauggguuc

SEQ ID NO: 1381259 - RNA, 23 nt, Human
gcacuauagucccaucuguggug

SEQ ID NO: 1381260 - RNA, 21 nt, Human
gcuccacccaaaaaugccugc

SEQ ID NO: 1381261 - RNA, 27 nt, Human
gcucugucacccaggcuggagugcaau

SEQ ID NO: 1381262 - RNA, 24 nt, Human
gcuggagugcaauagcgugaucug

SEQ ID NO: 1381263 - RNA, 23 nt, Human
gcuggucuugaacuccugaccuc

SEQ ID NO: 1381264 - RNA, 19 nt, Human
ggaacauguacucucacag

SEQ ID NO: 1381265 - RNA, 19 nt, Human
ggacagaaaucgggaggga

SEQ ID NO: 1381266 - RNA, 23 nt, Human
ggagaaaaguccccugauuucca

SEQ ID NO: 1381267 - RNA, 20 nt, Human
ggcuaaguucuuugugggaa

SEQ ID NO: 1381268 - RNA, 24 nt, Human
ggcuggucuugaacuccugaccuc

SEQ ID NO: 1381269 - RNA, 27 nt, Human
gggaacauguacucucacagugcccuc

SEQ ID NO: 1381270 - RNA, 23 nt, Human
gggguuucaacacguuggccagg

SEQ ID NO: 1381271 - RNA, 18 nt, Human
gggguuucaccaugcugg

SEQ ID NO: 1381272 - RNA, 22 nt, Human
gggguuucaccaugcuggccag

SEQ ID NO: 1381273 - RNA, 23 nt, Human
gggguuucaccaugcuggccagg

SEQ ID NO: 1381274 - RNA, 21 nt, Human
ggguaaggagaagggacgaag

SEQ ID NO: 1381275 - RNA, 20 nt, Human
ggguucaagcaauucuccug

SEQ ID NO: 1381276 - RNA, 22 nt, Human
ggguuucaacacguuggccagg

SEQ ID NO: 1381277 - RNA, 19 nt, Human
ggucuugaacuccugaccu

SEQ ID NO: 1381278 - RNA, 22 nt, Human
gugaaagaacagcuacuccaca

SEQ ID NO: 1381279 - RNA, 24 nt, Human
gugauccaccccccucagccuccc

SEQ ID NO: 1381280 - RNA, 18 nt, Human
guggguacagagugggac

SEQ ID NO: 1381281 - RNA, 20 nt, Human
gugugcaaaaccaaacaaaa

SEQ ID NO: 1381282 - RNA, 25 nt, Human
uaaaagcaaguuuauuaagaaagua

SEQ ID NO: 1381283 - RNA, 18 nt, Human
uaaaaucccuaagaccag

SEQ ID NO: 1381284 - RNA, 19 nt, Human
uaacagcagugaggauugg

SEQ ID NO: 1381285 - RNA, 21 nt, Human
uaacagcagugaggauuggaa

SEQ ID NO: 1381286 - RNA, 18 nt, Human
uaacccgaggucggucaa

SEQ ID NO: 1381287 - RNA, 21 nt, Human
uaacucagggcaaguccgcgg

SEQ ID NO: 1381288 - RNA, 22 nt, Human
uaagaggggccucuaacccacu

SEQ ID NO: 1381289 - RNA, 19 nt, Human
uaaggagaagggacgaagg

SEQ ID NO: 1381290 - RNA, 24 nt, Human
uaaggcaaaauaaaugaagaggau

SEQ ID NO: 1381291 - RNA, 24 nt, Human
uaauguuuguauuuuuaguagaga

SEQ ID NO: 1381292 - RNA, 24 nt, Human
uaauuuuuguauuuuuaguagaga

SEQ ID NO: 1381293 - RNA, 21 nt, Human
uacaacacagagacaacaaaa

SEQ ID NO: 1381294 - RNA, 24 nt, Human
uacaacacagagacaacaaaacau

SEQ ID NO: 1381295 - RNA, 23 nt, Human
uacagagugggacuagcugggua

SEQ ID NO: 1381296 - RNA, 23 nt, Human
uacaggcacuugucaccaucccc

SEQ ID NO: 1381297 - RNA, 21 nt, Human
uacaggugugagccaccgcac

SEQ ID NO: 1381298 - RNA, 21 nt, Human
uacaggugugagccaccgcac

SEQ ID NO: 1381299 - RNA, 23 nt, Human
uacaggugugagccaccgcacuu

SEQ ID NO: 1381300 - RNA, 24 nt, Human
uaguagagaagggguuucaccaug

SEQ ID NO: 1381301 - RNA, 19 nt, Human
uaguagagacgggguuuca

SEQ ID NO: 1381302 - RNA, 24 nt, Human
uaguagagacgggguuucaacacg

SEQ ID NO: 1381303 - RNA, 23 nt, Human
uagugugcaaaaccaaacaaaac

SEQ ID NO: 1381304 - RNA, 22 nt, Human
ucaaaccuguuuuuuagccgag

SEQ ID NO: 1381305 - RNA, 19 nt, Human
ucaagcaauucuccugccu

SEQ ID NO: 1381306 - RNA, 18 nt, Human
ucacccaggcuggagugc

SEQ ID NO: 1381307 - RNA, 18 nt, Human
ucacugcaacuuccaccu

SEQ ID NO: 1381308 - RNA, 23 nt, Human
ucacugcaacuuccaccucaugg

SEQ ID NO: 1381309 - RNA, 24 nt, Human
ucacugcaacuuccaccucauggg

SEQ ID NO: 1381310 - RNA, 18 nt, Human
ucagccucccaaagugcu

SEQ ID NO: 1381311 - RNA, 20 nt, Human
ucaggugaucugccugccuc

SEQ ID NO: 1381312 - RNA, 26 nt, Human
ucagguggacuacagggagaaagaaa

SEQ ID NO: 1381313 - RNA, 24 nt, Human
ucauggguucaagcaauucuccug

SEQ ID NO: 1381314 - RNA, 23 nt, Human
ucccaaagugcugggauuacagg

SEQ ID NO: 1381315 - RNA, 21 nt, Human
uccgcggugcaaaauaaaagc

SEQ ID NO: 1381316 - RNA, 19 nt, Human
uccgcuccacccaaaaaug

SEQ ID NO: 1381317 - RNA, 21 nt, Human
uccuagauuaaagcgauucuc

SEQ ID NO: 1381318 - RNA, 24 nt, Human
uccuagauuaaagcgauucuccug

SEQ ID NO: 1381319 - RNA, 18 nt, Human
uccuccacuguacaacac

SEQ ID NO: 1381320 - RNA, 24 nt, Human
ucgcucugucacccaggcuggagu

SEQ ID NO: 1381321 - RNA, 18 nt, Human
ucggccucccaaagugcu

SEQ ID NO: 1381322 - RNA, 18 nt, Human
ucggucaaguguccuugc

SEQ ID NO: 1381323 - RNA, 24 nt, Human
ucuauauauagggucaaaccagac

SEQ ID NO: 1381324 - RNA, 28 nt, Human
ucucaaacucaucuacaaauuuuccugg

SEQ ID NO: 1381325 - RNA, 20 nt, Human
ucuccugaaaaugacacuga

SEQ ID NO: 1381326 - RNA, 23 nt, Human
ucucgaacuccugauuucaggug

SEQ ID NO: 1381327 - RNA, 19 nt, Human
ucucgcucugucacccagg

SEQ ID NO: 1381328 - RNA, 22 nt, Human
ucucgcucugucacccaggcug

SEQ ID NO: 1381329 - RNA, 23 nt, Human
ucucgcucugucacccaggcugg

SEQ ID NO: 1381330 - RNA, 24 nt, Human
ucucgcucugucacccaggcugga

SEQ ID NO: 1381331 - RNA, 26 nt, Human
ucucgcucugucacccaggcuggagu

SEQ ID NO: 1381332 - RNA, 27 nt, Human
ucucgcucugucacccaggcuggagug

SEQ ID NO: 1381333 - RNA, 24 nt, Human
ucugucacccaggcuggagugcaa

SEQ ID NO: 1381334 - RNA, 18 nt, Human
ucuguugagaagacugcu

SEQ ID NO: 1381335 - RNA, 21 nt, Human
ucuugaacuccugaccucaag

SEQ ID NO: 1381336 - RNA, 20 nt, Human
ugaaagaacagcuacuccac

SEQ ID NO: 1381337 - RNA, 23 nt, Human
ugaaagaacagcuacuccacaga

SEQ ID NO: 1381338 - RNA, 26 nt, Human
ugacacugaaacggagacagcaacca

SEQ ID NO: 1381339 - RNA, 22 nt, Human
ugaccucaagugauccaccccc

SEQ ID NO: 1381340 - RNA, 23 nt, Human
ugacucagcaucccaagaagcug

SEQ ID NO: 1381341 - RNA, 20 nt, Human
ugacucagccacgucaaugg

SEQ ID NO: 1381342 - RNA, 22 nt, Human
ugagacagagucucgcucuguu

SEQ ID NO: 1381343 - RNA, 22 nt, Human
ugagauuacaggcacuugucac

SEQ ID NO: 1381344 - RNA, 24 nt, Human
ugagauuacaggcacuugucacca

SEQ ID NO: 1381345 - RNA, 25 nt, Human
ugagauuacaggcacuugucaccau

SEQ ID NO: 1381346 - RNA, 24 nt, Human
ugauuucaggugaucugccugccu

SEQ ID NO: 1381347 - RNA, 23 nt, Human
ugauuuccauccuagugcuucuc

SEQ ID NO: 1381348 - RNA, 19 nt, Human
ugcaaaaccaaacaaaaca

SEQ ID NO: 1381349 - RNA, 25 nt, Human
ugcaacuuccaccucauggguucaa

SEQ ID NO: 1381350 - RNA, 20 nt, Human
ugccucagccgcccaaguag

SEQ ID NO: 1381351 - RNA, 21 nt, Human
ugccucggccucccaaagugc

SEQ ID NO: 1381352 - RNA, 24 nt, Human
ugccucggccucccaaagugcugg

SEQ ID NO: 1381353 - RNA, 18 nt, Human
ugcuggccaggcuggucu

SEQ ID NO: 1381354 - RNA, 24 nt, Human
ugcugggauuacaggugugagcca

SEQ ID NO: 1381355 - RNA, 24 nt, Human
ugcuuuugguucccaguguuucac

SEQ ID NO: 1381356 - RNA, 18 nt, Human
uggagugcaguggugcaa

SEQ ID NO: 1381357 - RNA, 23 nt, Human
uggagugcaguggugcaaucuca

SEQ ID NO: 1381358 - RNA, 24 nt, Human
uggagugcaguggugcaaucucag

SEQ ID NO: 1381359 - RNA, 24 nt, Human
uggccaggauggucucgaacuccu

SEQ ID NO: 1381360 - RNA, 24 nt, Human
uggccaggcuggucuugaacuccu

SEQ ID NO: 1381361 - RNA, 19 nt, Human
ugggauuacagaugucugc

SEQ ID NO: 1381362 - RNA, 21 nt, Human
ugggauuacagaugucugcca

SEQ ID NO: 1381363 - RNA, 22 nt, Human
ugggauuacagaugucugccac

SEQ ID NO: 1381364 - RNA, 24 nt, Human
ugggauuacagaugucugccacua

SEQ ID NO: 1381365 - RNA, 18 nt, Human
ugggauuacaggugugag

SEQ ID NO: 1381366 - RNA, 19 nt, Human
ugggauuacaggugugagc

SEQ ID NO: 1381367 - RNA, 21 nt, Human
ugggauuacaggugugagcca

SEQ ID NO: 1381368 - RNA, 22 nt, Human
ugggauuacaggugugagccac

SEQ ID NO: 1381369 - RNA, 23 nt, Human
ugggauuacaggugugagccacc

SEQ ID NO: 1381370 - RNA, 24 nt, Human
ugggauuacaggugugagccaccg

SEQ ID NO: 1381371 - RNA, 21 nt, Human
ugggccucuaacccaaucccu

SEQ ID NO: 1381372 - RNA, 21 nt, Human
uggguucaagcaauucuccug

SEQ ID NO: 1381373 - RNA, 23 nt, Human
uggguucaagcaauucuccugcc

SEQ ID NO: 1381374 - RNA, 24 nt, Human
uggguucaagcaauucuccugccu

SEQ ID NO: 1381375 - RNA, 24 nt, Human
uggugcaaucucagcuaacugcaa

SEQ ID NO: 1381376 - RNA, 24 nt, Human
uguacaacacagagacaacaaaac

SEQ ID NO: 1381377 - RNA, 21 nt, Human
uguauuuuuaguagagacggg

SEQ ID NO: 1381378 - RNA, 20 nt, Human
ugucacccaggcuggagugc

SEQ ID NO: 1381379 - RNA, 21 nt, Human
ugugcaaaaccaaacaaaaca

SEQ ID NO: 1381380 - RNA, 24 nt, Human
uguugagaagacugcuggagugca

SEQ ID NO: 1381381 - RNA, 21 nt, Human
uguuuguauuuuuaguagaga

SEQ ID NO: 1381382 - RNA, 23 nt, Human
uuaaccguaaguaucugaaagcu

SEQ ID NO: 1381383 - RNA, 18 nt, Human
uuaguagagaagggguuu

SEQ ID NO: 1381384 - RNA, 22 nt, Human
uuaguagagaagggguuucacc

SEQ ID NO: 1381385 - RNA, 24 nt, Human
uuaguagagaagggguuucaccau

SEQ ID NO: 1381386 - RNA, 18 nt, Human
uuaguagagacgggguuu

SEQ ID NO: 1381387 - RNA, 22 nt, Human
uuaguagagacgggguuucaac

SEQ ID NO: 1381388 - RNA, 21 nt, Human
uucaagcaauucuccugccuc

SEQ ID NO: 1381389 - RNA, 26 nt, Human
uucaagcaauucuccugccucagccg

SEQ ID NO: 1381390 - RNA, 21 nt, Human
uucuccagauauccagcuauc

SEQ ID NO: 1381391 - RNA, 23 nt, Human
uuguauuuuuaguagagacgggg

SEQ ID NO: 1381392 - RNA, 21 nt, Human
uuucaccaugcuggccaggcu

SEQ ID NO: 1381393 - RNA, 19 nt, Human
uuuggguugggggaguuuc

SEQ ID NO: 1381394 - RNA, 18 nt, Human
uuuguauuuuuaguagag

SEQ ID NO: 1381395 - RNA, 24 nt, Human
uuuuuaguagagaagggguuucac

SEQ ID NO: 1381396 - RNA, 22 nt, Human
uuuuuaguagagacgggguuuc

SEQ ID NO: 1381397 - RNA, 20 nt, Human
uuuuuguauuuuuaguagag

SEQ ID NO: 1381398 - RNA, 22 nt, Human
aacauaucucccuccacuccua

SEQ ID NO: 1381399 - RNA, 22 nt, Human
aagcaacaggaguaaggcacag

SEQ ID NO: 1381400 - RNA, 24 nt, Human
acagagcagcgcucucgacugggg

SEQ ID NO: 1381401 - RNA, 21 nt, Human
acagcagaauucccaccagcu

SEQ ID NO: 1381402 - RNA, 21 nt, Human
acccugcuugcuggagaggga

SEQ ID NO: 1381403 - RNA, 23 nt, Human
acucccuucccuucuggagcugg

SEQ ID NO: 1381404 - RNA, 21 nt, Human
agcaacaggaguaaggcacag

SEQ ID NO: 1381405 - RNA, 21 nt, Human
agcagcuaaacugcaacaaaa

SEQ ID NO: 1381406 - RNA, 25 nt, Human
agccaccaaaagucuauagcaagcu

SEQ ID NO: 1381407 - RNA, 19 nt, Human
agccauugguguagaugac

SEQ ID NO: 1381408 - RNA, 22 nt, Human
agcuaaacugcaacaaaaccca

SEQ ID NO: 1381409 - RNA, 23 nt, Human
aggaaaucccuccacagcagcua

SEQ ID NO: 1381410 - RNA, 19 nt, Human
agggaccaggguuccaaac

SEQ ID NO: 1381411 - RNA, 20 nt, Human
agggaccaggguuccaaacu

SEQ ID NO: 1381412 - RNA, 21 nt, Human
aguaagggagguggggaagaa

SEQ ID NO: 1381413 - RNA, 21 nt, Human
caacaggaguaaggcacagag

SEQ ID NO: 1381414 - RNA, 18 nt, Human
cacagagcagcgcucucg

SEQ ID NO: 1381415 - RNA, 22 nt, Human
cacagccaggucucacuggcac

SEQ ID NO: 1381416 - RNA, 24 nt, Human
caccaaaagucuauagcaagcuuc

SEQ ID NO: 1381417 - RNA, 21 nt, Human
cacugccaaguuaaagaaaac

SEQ ID NO: 1381418 - RNA, 20 nt, Human
cagagccaccaaaagucuau

SEQ ID NO: 1381419 - RNA, 19 nt, Human
cagcgcucucgacuggggu

SEQ ID NO: 1381420 - RNA, 20 nt, Human
caggaguaggcaagcaacag

SEQ ID NO: 1381421 - RNA, 22 nt, Human
caggcaaauggaagugaucaaa

SEQ ID NO: 1381422 - RNA, 26 nt, Human
ccaaguggaguccaggcagggcugcc

SEQ ID NO: 1381423 - RNA, 21 nt, Human
ccacaccaccaaguaagaaua

SEQ ID NO: 1381424 - RNA, 18 nt, Human
cccaguugccuucgccug

SEQ ID NO: 1381425 - RNA, 20 nt, Human
ccccagccgacccccaggcu

SEQ ID NO: 1381426 - RNA, 18 nt, Human
cccccaggcucucuccuc

SEQ ID NO: 1381427 - RNA, 20 nt, Human
cccccaggcucucuccucac

SEQ ID NO: 1381428 - RNA, 21 nt, Human
cccccaggcucucuccucacu

SEQ ID NO: 1381429 - RNA, 20 nt, Human
cgacccccaggcucucuccu

SEQ ID NO: 1381430 - RNA, 20 nt, Human
cugcaacaaaacccaccaga

SEQ ID NO: 1381431 - RNA, 22 nt, Human
cugccauguuuccauggaaaug

SEQ ID NO: 1381432 - RNA, 20 nt, Human
cugguuguagagcuguagcu

SEQ ID NO: 1381433 - RNA, 19 nt, Human
cuuguaggaaaucccucca

SEQ ID NO: 1381434 - RNA, 19 nt, Human
cuuugaucugauucacuag

SEQ ID NO: 1381435 - RNA, 20 nt, Human
gaaaucccuccacagcagcu

SEQ ID NO: 1381436 - RNA, 26 nt, Human
gaaugggguggggguguuaccacuuc

SEQ ID NO: 1381437 - RNA, 21 nt, Human
gaccaggguuccaaacuuuuu

SEQ ID NO: 1381438 - RNA, 20 nt, Human
gacccccaggcucucuccuc

SEQ ID NO: 1381439 - RNA, 26 nt, Human
gcaagcaacaggaguaaggcacagag

SEQ ID NO: 1381440 - RNA, 22 nt, Human
gccuuaaacuuugagcuccagc

SEQ ID NO: 1381441 - RNA, 18 nt, Human
gcugggggauggccaggc

SEQ ID NO: 1381442 - RNA, 20 nt, Human
ggaagaauuuggcugcuguu

SEQ ID NO: 1381443 - RNA, 20 nt, Human
ggaguccaggcagggcugcc

SEQ ID NO: 1381444 - RNA, 19 nt, Human
ggggaauggggugggggug

SEQ ID NO: 1381445 - RNA, 22 nt, Human
guccuuguaggaaaucccucca

SEQ ID NO: 1381446 - RNA, 24 nt, Human
uaacuuaccacugugcuuguuggu

SEQ ID NO: 1381447 - RNA, 19 nt, Human
uaagaauagguugcugugu

SEQ ID NO: 1381448 - RNA, 21 nt, Human
uagcaagcuucuacugggaac

SEQ ID NO: 1381449 - RNA, 20 nt, Human
ucacugccugcuccacuccc

SEQ ID NO: 1381450 - RNA, 24 nt, Human
uccacagcagcuaaacugcaacaa

SEQ ID NO: 1381451 - RNA, 26 nt, Human
ucgccugaagauauucucacuucuua

SEQ ID NO: 1381452 - RNA, 20 nt, Human
ugaucacugccuggucagga

SEQ ID NO: 1381453 - RNA, 22 nt, Human
ugcaggcaaauggaagugauca

SEQ ID NO: 1381454 - RNA, 21 nt, Human
ugcaggggaauggggugggga

SEQ ID NO: 1381455 - RNA, 20 nt, Human
ugccuggucaggaguaggca

SEQ ID NO: 1381456 - RNA, 18 nt, Human
ugcuccacucccuucccu

SEQ ID NO: 1381457 - RNA, 23 nt, Human
ugcuccacucccuucccuucugg

SEQ ID NO: 1381458 - RNA, 18 nt, Human
ugcuggagagggagggcc

SEQ ID NO: 1381459 - RNA, 19 nt, Human
ugcuggagagggagggcca

SEQ ID NO: 1381460 - RNA, 23 nt, Human
ugcuguguauccaguugaccaac

SEQ ID NO: 1381461 - RNA, 20 nt, Human
ugcuugcuggagagggaggg

SEQ ID NO: 1381462 - RNA, 18 nt, Human
uggcucagucccacuucu

SEQ ID NO: 1381463 - RNA, 26 nt, Human
uggcuuugcaggcaaaugggggaacc

SEQ ID NO: 1381464 - RNA, 18 nt, Human
ugggaggauggcaggaca

SEQ ID NO: 1381465 - RNA, 19 nt, Human
uggggaagaauuuggcugc

SEQ ID NO: 1381466 - RNA, 18 nt, Human
uguauggcucagucccac

SEQ ID NO: 1381467 - RNA, 21 nt, Human
uuacaguuguacauauauuuu

SEQ ID NO: 1381468 - RNA, 21 nt, Human
uucacuaggaucugggacagc

SEQ ID NO: 1381469 - RNA, 22 nt, Human
uuccaaguagucaaaggccugc

SEQ ID NO: 1381470 - RNA, 25 nt, Human
uucgaaguaagggagguggggaaga

SEQ ID NO: 1381471 - RNA, 19 nt, Human
uucuugagagaaguuucug

SEQ ID NO: 1381472 - RNA, 21 nt, Human
uuucgaaguaagggagguggg

SEQ ID NO: 1381473 - RNA, 19 nt, Human
aaaccagaguccaggcaac

SEQ ID NO: 1381474 - RNA, 25 nt, Human
aaaccagaguccaggcaacgaagca

SEQ ID NO: 1381475 - RNA, 21 nt, Human
aagccccgcccccagcagucc

SEQ ID NO: 1381476 - RNA, 20 nt, Human
accaagccccgcccccagca

SEQ ID NO: 1381477 - RNA, 22 nt, Human
accaccaagccccgcccccagc

SEQ ID NO: 1381478 - RNA, 20 nt, Human
agaccggccuccagccggua

SEQ ID NO: 1381479 - RNA, 20 nt, Human
aggcagagggaggaccaacu

SEQ ID NO: 1381480 - RNA, 19 nt, Human
aggccccggcuugcuccag

SEQ ID NO: 1381481 - RNA, 26 nt, Human
caaagcccaccccucugagccccagg

SEQ ID NO: 1381482 - RNA, 22 nt, Human
caacgaagcagcgucgacccuc

SEQ ID NO: 1381483 - RNA, 22 nt, Human
cacaguguugcaagaacccgcu

SEQ ID NO: 1381484 - RNA, 21 nt, Human
caccaccaagccccgccccca

SEQ ID NO: 1381485 - RNA, 23 nt, Human
cagcagucaccaccaagccccgc

SEQ ID NO: 1381486 - RNA, 23 nt, Human
cagcagucccccgcuccugcaag

SEQ ID NO: 1381487 - RNA, 18 nt, Human
ccagcagucccccgcucc

SEQ ID NO: 1381488 - RNA, 20 nt, Human
cccaccccucugagccccag

SEQ ID NO: 1381489 - RNA, 18 nt, Human
ccccagcagucccccgcu

SEQ ID NO: 1381490 - RNA, 19 nt, Human
ccccgccagcagucaccac

SEQ ID NO: 1381491 - RNA, 19 nt, Human
ccccgcccccagcaguccc

SEQ ID NO: 1381492 - RNA, 22 nt, Human
ccucugagccccaggccccgcc

SEQ ID NO: 1381493 - RNA, 20 nt, Human
ccugcaagaccggccuccag

SEQ ID NO: 1381494 - RNA, 18 nt, Human
ccuuugcucuuugggggc

SEQ ID NO: 1381495 - RNA, 18 nt, Human
ccuuugcucuuugggggc

SEQ ID NO: 1381496 - RNA, 19 nt, Human
cgccagcagucaccaccaa

SEQ ID NO: 1381497 - RNA, 22 nt, Human
cgccagcagucaccaccaagcc

SEQ ID NO: 1381498 - RNA, 21 nt, Human
cggaagcagauuuagggaggg

SEQ ID NO: 1381499 - RNA, 19 nt, Human
cucacaguguugcaagaac

SEQ ID NO: 1381500 - RNA, 18 nt, Human
cuccaaagcccaccccuc

SEQ ID NO: 1381501 - RNA, 20 nt, Human
cugagccccaggccccgccc

SEQ ID NO: 1381502 - RNA, 25 nt, Human
ggaaggggauggggcugccuccugg

SEQ ID NO: 1381503 - RNA, 21 nt, Human
ggagggccuacuuaggggcug

SEQ ID NO: 1381504 - RNA, 22 nt, Human
ggcccaucuuuggggcuaagac

SEQ ID NO: 1381505 - RNA, 20 nt, Human
ggggcuggaaggggaugggg

SEQ ID NO: 1381506 - RNA, 22 nt, Human
ggugcggaagcagauuuaggga

SEQ ID NO: 1381507 - RNA, 19 nt, Human
guugccuuugcucuuuggg

SEQ ID NO: 1381508 - RNA, 24 nt, Human
ucaccaccaagccccgcccccagc

SEQ ID NO: 1381509 - RNA, 25 nt, Human
uccaaagcccaccccucugagcccc

SEQ ID NO: 1381510 - RNA, 19 nt, Human
ucugggagagagaaggccc

SEQ ID NO: 1381511 - RNA, 22 nt, Human
ucuugcuguugccuuugcucuu

SEQ ID NO: 1381512 - RNA, 20 nt, Human
ugagaggaaaggcagaggga

SEQ ID NO: 1381513 - RNA, 25 nt, Human
ugagaggaaaggcagagggaggacc

SEQ ID NO: 1381514 - RNA, 20 nt, Human
ugagccccaggccccgcccc

SEQ ID NO: 1381515 - RNA, 22 nt, Human
ugagccccaggccccgccccgc

SEQ ID NO: 1381516 - RNA, 21 nt, Human
ugaucuccaaagcccaccccu

SEQ ID NO: 1381517 - RNA, 22 nt, Human
ugccuuugcucuuugggggcuu

SEQ ID NO: 1381518 - RNA, 23 nt, Human
uggggcugccuccuggagugugg

SEQ ID NO: 1381519 - RNA, 19 nt, Human
uugccuuugcucuuugggg

SEQ ID NO: 1381520 - RNA, 21 nt, Human
aaaaaaaaaaaacaccuagaa

SEQ ID NO: 1381521 - RNA, 24 nt, Human
aaaaggaacaaaaauagaaaacaa

SEQ ID NO: 1381522 - RNA, 21 nt, Human
aaacuacuucuaucuuaaaua

SEQ ID NO: 1381523 - RNA, 24 nt, Human
aaauagaaaacaaguucuagagaa

SEQ ID NO: 1381524 - RNA, 21 nt, Human
aaauggcaguaaaggcuguug

SEQ ID NO: 1381525 - RNA, 22 nt, Human
aacucaauauuuguaucucaca

SEQ ID NO: 1381526 - RNA, 24 nt, Human
aagguaaguuuucuuauugguaug

SEQ ID NO: 1381527 - RNA, 26 nt, Human
aauaauaaauacaaguuaguagcucc

SEQ ID NO: 1381528 - RNA, 20 nt, Human
aaucucagcuucagugaaau

SEQ ID NO: 1381529 - RNA, 24 nt, Human
acaguggaaaaacauacagcugga

SEQ ID NO: 1381530 - RNA, 19 nt, Human
accuccaaaaccucuacca

SEQ ID NO: 1381531 - RNA, 24 nt, Human
acugcaauuaaaagucuuccaauu

SEQ ID NO: 1381532 - RNA, 19 nt, Human
agaacaugaauuuauaagu

SEQ ID NO: 1381533 - RNA, 19 nt, Human
agaaucucuaacaaugaag

SEQ ID NO: 1381534 - RNA, 23 nt, Human
aguggaaaaacauacagcuggaa

SEQ ID NO: 1381535 - RNA, 19 nt, Human
auacauuauuuacaucuuu

SEQ ID NO: 1381536 - RNA, 19 nt, Human
augcacuaaucuuuuuuac

SEQ ID NO: 1381537 - RNA, 21 nt, Human
caaagcauccuuaaaaugaaa

SEQ ID NO: 1381538 - RNA, 22 nt, Human
caaugaugcuaccaaugcuuaa

SEQ ID NO: 1381539 - RNA, 25 nt, Human
caccuuaaaaagaaaguucuacaac

SEQ ID NO: 1381540 - RNA, 24 nt, Human
cacuaaucuuuuuuacaaccugca

SEQ ID NO: 1381541 - RNA, 19 nt, Human
caggaaacuauucuuuuau

SEQ ID NO: 1381542 - RNA, 18 nt, Human
caguaguuaaaauuaaau

SEQ ID NO: 1381543 - RNA, 21 nt, Human
cauaagcaaggaaaaugcuaa

SEQ ID NO: 1381544 - RNA, 21 nt, Human
caucacauacaagucuguaua

SEQ ID NO: 1381545 - RNA, 22 nt, Human
caucucuauuuccugauaagag

SEQ ID NO: 1381546 - RNA, 19 nt, Human
cauggcacauuccuuugaa

SEQ ID NO: 1381547 - RNA, 19 nt, Human
ccacaucaucucuauuucc

SEQ ID NO: 1381548 - RNA, 21 nt, Human
cccaaaagaaccacucugaag

SEQ ID NO: 1381549 - RNA, 27 nt, Human
cccaaaagaaccacucugaagaugaag

SEQ ID NO: 1381550 - RNA, 20 nt, Human
cccuucuaguuacuugauua

SEQ ID NO: 1381551 - RNA, 22 nt, Human
ccugauaagagacuguaguguu

SEQ ID NO: 1381552 - RNA, 20 nt, Human
cuacaagugacagacauaca

SEQ ID NO: 1381553 - RNA, 19 nt, Human
cuagaacaguuccaaaaac

SEQ ID NO: 1381554 - RNA, 20 nt, Human
cuauccuacaguaguuaaaa

SEQ ID NO: 1381555 - RNA, 19 nt, Human
cuccaaaaccucuaccagc

SEQ ID NO: 1381556 - RNA, 24 nt, Human
cugaaaccuaugaauugacaguaa

SEQ ID NO: 1381557 - RNA, 22 nt, Human
cuggaauaaacagugcucccaa

SEQ ID NO: 1381558 - RNA, 28 nt, Human
gaaaaugcacuaaucuuuuuuacaaccu

SEQ ID NO: 1381559 - RNA, 27 nt, Human
gaacaaaaauagaaaacaaguucuaga

SEQ ID NO: 1381560 - RNA, 18 nt, Human
gaacaguuccaaaaacaa

SEQ ID NO: 1381561 - RNA, 22 nt, Human
gaagaccugcaaaaucagccua

SEQ ID NO: 1381562 - RNA, 24 nt, Human
gcuccaaaaaaacuacuuucccua

SEQ ID NO: 1381563 - RNA, 19 nt, Human
gcucccaaaagaaccacuc

SEQ ID NO: 1381564 - RNA, 21 nt, Human
gcugaacaacagugauuucca

SEQ ID NO: 1381565 - RNA, 18 nt, Human
ggaacaaaaauagaaaac

SEQ ID NO: 1381566 - RNA, 18 nt, Human
gggaagguagaaagagac

SEQ ID NO: 1381567 - RNA, 21 nt, Human
gguaaauuaaccuccaaaacc

SEQ ID NO: 1381568 - RNA, 23 nt, Human
gugcucccaaaagaaccacucug

SEQ ID NO: 1381569 - RNA, 19 nt, Human
gugguuaucaaaaccuguc

SEQ ID NO: 1381570 - RNA, 24 nt, Human
guucaucugagugaaaacauuuaa

SEQ ID NO: 1381571 - RNA, 24 nt, Human
uaaaaaguaaaaccuccacaucca

SEQ ID NO: 1381572 - RNA, 25 nt, Human
uaaaaagucauuucugucgaacaau

SEQ ID NO: 1381573 - RNA, 19 nt, Human
uaaauuacaguugagcuga

SEQ ID NO: 1381574 - RNA, 20 nt, Human
uaaauuucaaaauaagguaa

SEQ ID NO: 1381575 - RNA, 20 nt, Human
uaagguaaauuaaccuccaa

SEQ ID NO: 1381576 - RNA, 24 nt, Human
uaaguaaaaaacaauuuaauauua

SEQ ID NO: 1381577 - RNA, 21 nt, Human
uaccaaugcuuaaaacauucu

SEQ ID NO: 1381578 - RNA, 25 nt, Human
uagagaaaggacuugguuuuuuucc

SEQ ID NO: 1381579 - RNA, 23 nt, Human
uagcuggaauaaacagugcuccc

SEQ ID NO: 1381580 - RNA, 21 nt, Human
uauaaacauugaguuucuucu

SEQ ID NO: 1381581 - RNA, 23 nt, Human
uaugcagaaaaaguuauuacauu

SEQ ID NO: 1381582 - RNA, 19 nt, Human
uauguaauauauaaauauc

SEQ ID NO: 1381583 - RNA, 23 nt, Human
uauucaccuuaaaaagaaaguuc

SEQ ID NO: 1381584 - RNA, 19 nt, Human
ucaaaauagugacaucagg

SEQ ID NO: 1381585 - RNA, 18 nt, Human
ucaaauuaaacuuuucca

SEQ ID NO: 1381586 - RNA, 20 nt, Human
ucaaugaugcuaccaaugcu

SEQ ID NO: 1381587 - RNA, 26 nt, Human
uccaaaaccucuaccagcaacuaaca

SEQ ID NO: 1381588 - RNA, 21 nt, Human
uccacuuuuccauaguaucca

SEQ ID NO: 1381589 - RNA, 20 nt, Human
ucccuaaaaagucauuucug

SEQ ID NO: 1381590 - RNA, 22 nt, Human
ucucuaacaaugaagaccugca

SEQ ID NO: 1381591 - RNA, 26 nt, Human
ucuuuaaaaaaaaaaaaacaccuaga

SEQ ID NO: 1381592 - RNA, 19 nt, Human
ugaaaaggaacaaaaauag

SEQ ID NO: 1381593 - RNA, 22 nt, Human
ugaaaaggaacaaaaauagaaa

SEQ ID NO: 1381594 - RNA, 24 nt, Human
ugaaaaggaacaaaaauagaaaac

SEQ ID NO: 1381595 - RNA, 25 nt, Human
ugaagaccugcaaaaucagccuaau

SEQ ID NO: 1381596 - RNA, 23 nt, Human
ugaaucaguucagcuacaaguga

SEQ ID NO: 1381597 - RNA, 24 nt, Human
ugacaguaaauacuucagaaucuc

SEQ ID NO: 1381598 - RNA, 27 nt, Human
ugaguuucuucuuuaaaaaaaaaaaaa

SEQ ID NO: 1381599 - RNA, 21 nt, Human
ugcaguaaaaguuaaaccuau

SEQ ID NO: 1381600 - RNA, 22 nt, Human
uggaaaaacauacagcuggaaa

SEQ ID NO: 1381601 - RNA, 18 nt, Human
uggaauaaacagugcucc

SEQ ID NO: 1381602 - RNA, 24 nt, Human
uggaauaaacagugcucccaaaag

SEQ ID NO: 1381603 - RNA, 19 nt, Human
uggauuucauaacuuagau

SEQ ID NO: 1381604 - RNA, 18 nt, Human
ugucaaaaugugaaucag

SEQ ID NO: 1381605 - RNA, 26 nt, Human
uguguacacgcacaguggaaaaacau

SEQ ID NO: 1381606 - RNA, 24 nt, Human
uguuuuauccauccugauaagaca

SEQ ID NO: 1381607 - RNA, 25 nt, Human
uuaaaauaagcuuaaaguauaaauc

SEQ ID NO: 1381608 - RNA, 24 nt, Human
uuaaacaaaaaugaagcaauuaaa

SEQ ID NO: 1381609 - RNA, 20 nt, Human
uuaaacuuugaucaguaaca

SEQ ID NO: 1381610 - RNA, 22 nt, Human
uuaaacuuugaucaguaacaac

SEQ ID NO: 1381611 - RNA, 21 nt, Human
uuaguucuauaugcagaaaaa

SEQ ID NO: 1381612 - RNA, 18 nt, Human
uuauugguaugcagucac

SEQ ID NO: 1381613 - RNA, 20 nt, Human
uucaaaauggauuauucucc

SEQ ID NO: 1381614 - RNA, 24 nt, Human
uuccugauaagagacuguaguguu

SEQ ID NO: 1381615 - RNA, 21 nt, Human
uucuaguuacuugauuauaag

SEQ ID NO: 1381616 - RNA, 21 nt, Human
uuggucccacaucuuuuaaaa

SEQ ID NO: 1381617 - RNA, 26 nt, Human
uuuaaaaaaaaaaaaacaccuagaau

SEQ ID NO: 1381618 - RNA, 22 nt, Human
uuuaaauauuucccaucccauc

SEQ ID NO: 1381619 - RNA, 18 nt, Human
uuuacuaucuaccuuuga

SEQ ID NO: 1381620 - RNA, 18 nt, Human
uuuguacaaaaaucucca

SEQ ID NO: 1381621 - RNA, 20 nt, Human
uuuguacaaaaaucuccagu

SEQ ID NO: 1381622 - RNA, 22 nt, Human
uuuucucucuuuugucaaaaug

SEQ ID NO: 1381623 - RNA, 22 nt, Human
aaaaaaagguaauguccacaaa

SEQ ID NO: 1381624 - RNA, 22 nt, Human
aaaaaaccaacagccacauaau

SEQ ID NO: 1381625 - RNA, 26 nt, Human
aaaaaacuccaaaccagcauuuggcc

SEQ ID NO: 1381626 - RNA, 25 nt, Human
aaaaacacagacacaaccuuuuccu

SEQ ID NO: 1381627 - RNA, 25 nt, Human
aaaaacuccaaaccagcauuuggcc

SEQ ID NO: 1381628 - RNA, 21 nt, Human
aaaaagauuccaacauaccua

SEQ ID NO: 1381629 - RNA, 22 nt, Human
aaaaagcagaauaaagaaaaac

SEQ ID NO: 1381630 - RNA, 24 nt, Human
aaacaaaagaucuaaaauaaaaca

SEQ ID NO: 1381631 - RNA, 20 nt, Human
aaacacauaaagaaagaaac

SEQ ID NO: 1381632 - RNA, 22 nt, Human
aaagaaagaaacgugaagaagc

SEQ ID NO: 1381633 - RNA, 23 nt, Human
aaagaaagaaacgugaagaagcc

SEQ ID NO: 1381634 - RNA, 19 nt, Human
aagaaaaacuuaaaaacac

SEQ ID NO: 1381635 - RNA, 20 nt, Human
aagaaagaaacgugaagaag

SEQ ID NO: 1381636 - RNA, 21 nt, Human
aagaaagaaacgugaagaagc

SEQ ID NO: 1381637 - RNA, 21 nt, Human
aagaagguccaauuuaaaaac

SEQ ID NO: 1381638 - RNA, 20 nt, Human
aagaggagacaaauugugua

SEQ ID NO: 1381639 - RNA, 25 nt, Human
acaaaaaaagguaauguccacaaaa

SEQ ID NO: 1381640 - RNA, 21 nt, Human
acaauauaaagaagguccaau

SEQ ID NO: 1381641 - RNA, 24 nt, Human
acagacacaaccuuuuccuguuac

SEQ ID NO: 1381642 - RNA, 23 nt, Human
acccugacagacaacugaaacaa

SEQ ID NO: 1381643 - RNA, 18 nt, Human
acugccucuugagucaca

SEQ ID NO: 1381644 - RNA, 20 nt, Human
agaaagaaacgugaagaagc

SEQ ID NO: 1381645 - RNA, 26 nt, Human
agacagaagguugaauuggagggacc

SEQ ID NO: 1381646 - RNA, 22 nt, Human
agcaaaaaagcagaauaaagaa

SEQ ID NO: 1381647 - RNA, 24 nt, Human
agcaaaaaagcagaauaaagaaaa

SEQ ID NO: 1381648 - RNA, 19 nt, Human
agcagaaaacccacccaaa

SEQ ID NO: 1381649 - RNA, 21 nt, Human
agcagauuuuuuucuucuuuu

SEQ ID NO: 1381650 - RNA, 21 nt, Human
agccugauuaauuuacuaugg

SEQ ID NO: 1381651 - RNA, 19 nt, Human
aggcaaaaaaaagauucca

SEQ ID NO: 1381652 - RNA, 30 nt, Human
aggcaaaaaaaagauuccaacauaccuaag

SEQ ID NO: 1381653 - RNA, 25 nt, Human
aggcaucaacaauugggaauaaacc

SEQ ID NO: 1381654 - RNA, 21 nt, Human
aggcuauugucuuuuaaaauu

SEQ ID NO: 1381655 - RNA, 23 nt, Human
aggcuuuacagaacccuucugau

SEQ ID NO: 1381656 - RNA, 18 nt, Human
agucaggaaaaugaccca

SEQ ID NO: 1381657 - RNA, 20 nt, Human
auacaaacaucuccaaaaau

SEQ ID NO: 1381658 - RNA, 21 nt, Human
auaggucauauaacaucuguu

SEQ ID NO: 1381659 - RNA, 18 nt, Human
aucccaccacccuccucc

SEQ ID NO: 1381660 - RNA, 20 nt, Human
aucccaccacccuccuccaa

SEQ ID NO: 1381661 - RNA, 18 nt, Human
aucuguaugauuuucccc

SEQ ID NO: 1381662 - RNA, 24 nt, Human
augcuucagguaaucaauuugcau

SEQ ID NO: 1381663 - RNA, 21 nt, Human
caaaaaaacuccaaaccagca

SEQ ID NO: 1381664 - RNA, 18 nt, Human
caaaaaaccaacagccac

SEQ ID NO: 1381665 - RNA, 19 nt, Human
caaagucuuacagcaaaca

SEQ ID NO: 1381666 - RNA, 26 nt, Human
caaauuuucuuuccauguauagaggc

SEQ ID NO: 1381667 - RNA, 18 nt, Human
cacugccucuugagucac

SEQ ID NO: 1381668 - RNA, 22 nt, Human
cagaaaacccacccaaaacaaa

SEQ ID NO: 1381669 - RNA, 18 nt, Human
cagccacauaaucugugu

SEQ ID NO: 1381670 - RNA, 21 nt, Human
caucccaccacccuccuccaa

SEQ ID NO: 1381671 - RNA, 23 nt, Human
caucccaccacccuccuccaacu

SEQ ID NO: 1381672 - RNA, 25 nt, Human
caucccaccacccuccuccaacuaa

SEQ ID NO: 1381673 - RNA, 23 nt, Human
caucucaaaaaaccaacagccac

SEQ ID NO: 1381674 - RNA, 20 nt, Human
cauguugaggaaaaucuguc

SEQ ID NO: 1381675 - RNA, 21 nt, Human
ccaaaccagcauuuggccaac

SEQ ID NO: 1381676 - RNA, 24 nt, Human
ccaguagcuucuuaauuaaacccu

SEQ ID NO: 1381677 - RNA, 26 nt, Human
cccaacguuuucaacuacugccccaa

SEQ ID NO: 1381678 - RNA, 18 nt, Human
cccaccacccuccuccaa

SEQ ID NO: 1381679 - RNA, 22 nt, Human
ccucaaaaaaacuccaaaccag

SEQ ID NO: 1381680 - RNA, 23 nt, Human
cucaaaaaaacuccaaaccagca

SEQ ID NO: 1381681 - RNA, 18 nt, Human
cucaaaaaaccaacagcc

SEQ ID NO: 1381682 - RNA, 24 nt, Human
cucaaaaaaccaacagccacauaa

SEQ ID NO: 1381683 - RNA, 19 nt, Human
cuccuccuaggcaaaaaaa

SEQ ID NO: 1381684 - RNA, 23 nt, Human
cucuugagucacagauuuucaac

SEQ ID NO: 1381685 - RNA, 23 nt, Human
cugacagacaacugaaacaaaga

SEQ ID NO: 1381686 - RNA, 24 nt, Human
cuggcuccuccuaggcaaaaaaaa

SEQ ID NO: 1381687 - RNA, 23 nt, Human
cuuagaauuaauacuuccaauaa

SEQ ID NO: 1381688 - RNA, 25 nt, Human
gaaaaacuuaaaaacacagacacaa

SEQ ID NO: 1381689 - RNA, 19 nt, Human
gaaagcauacugugcaacc

SEQ ID NO: 1381690 - RNA, 20 nt, Human
gcagaaaacccacccaaaac

SEQ ID NO: 1381691 - RNA, 23 nt, Human
gcagaauaaagaaaaacuuaaaa

SEQ ID NO: 1381692 - RNA, 18 nt, Human
gccucuaucacuaggcac

SEQ ID NO: 1381693 - RNA, 20 nt, Human
gccuuuuuauucagcagauu

SEQ ID NO: 1381694 - RNA, 25 nt, Human
gcuagagucaggaaaaugacccagu

SEQ ID NO: 1381695 - RNA, 21 nt, Human
gucaucuuaaggguuguuucu

SEQ ID NO: 1381696 - RNA, 19 nt, Human
gugaacuuuaaauuccauu

SEQ ID NO: 1381697 - RNA, 19 nt, Human
uaaaaacacagacacaacc

SEQ ID NO: 1381698 - RNA, 20 nt, Human
uaaaaugacuaaaguaaaug

SEQ ID NO: 1381699 - RNA, 19 nt, Human
uaaaaugguuggcucacug

SEQ ID NO: 1381700 - RNA, 19 nt, Human
uaagaugucagguuugaaa

SEQ ID NO: 1381701 - RNA, 20 nt, Human
uaauaaaugggcuucucugu

SEQ ID NO: 1381702 - RNA, 22 nt, Human
uaauacaauauaaagaaggucc

SEQ ID NO: 1381703 - RNA, 18 nt, Human
uaauagaugacaaacaac

SEQ ID NO: 1381704 - RNA, 19 nt, Human
uaaucuguguuggaaacac

SEQ ID NO: 1381705 - RNA, 21 nt, Human
uacagcaaacacauaaagaaa

SEQ ID NO: 1381706 - RNA, 20 nt, Human
uacaguagcugauuacaaaa

SEQ ID NO: 1381707 - RNA, 22 nt, Human
uaccgcauucuauuuucaaggu

SEQ ID NO: 1381708 - RNA, 30 nt, Human
uacuauggaagaaauuagcauaaaaugacc

SEQ ID NO: 1381709 - RNA, 20 nt, Human
uacuuuauauauuagugaga

SEQ ID NO: 1381710 - RNA, 19 nt, Human
uagcagcaaaaaagcagaa

SEQ ID NO: 1381711 - RNA, 27 nt, Human
uagcagcaaaaaagcagaauaaagaaa

SEQ ID NO: 1381712 - RNA, 22 nt, Human
uagccaacaaauuuuuccccag

SEQ ID NO: 1381713 - RNA, 20 nt, Human
uagcuucuuaauuaaacccu

SEQ ID NO: 1381714 - RNA, 22 nt, Human
uauaauagaugacaaacaacgc

SEQ ID NO: 1381715 - RNA, 21 nt, Human
uaugacaucaucccaccaccc

SEQ ID NO: 1381716 - RNA, 19 nt, Human
ucaaaaaaacuccaaacca

SEQ ID NO: 1381717 - RNA, 21 nt, Human
ucaaaaaaccaacagccacau

SEQ ID NO: 1381718 - RNA, 18 nt, Human
ucacugccucuugaguca

SEQ ID NO: 1381719 - RNA, 21 nt, Human
uccaaguuuaaugcccaggau

SEQ ID NO: 1381720 - RNA, 21 nt, Human
uccccagaaaacaguauucug

SEQ ID NO: 1381721 - RNA, 26 nt, Human
uccccagaaaacaguauucuguucac

SEQ ID NO: 1381722 - RNA, 24 nt, Human
uccucaaaaaaacuccaaaccagc

SEQ ID NO: 1381723 - RNA, 20 nt, Human
ucuccaaaaauauugggagu

SEQ ID NO: 1381724 - RNA, 18 nt, Human
ugaaagcauacugugcaa

SEQ ID NO: 1381725 - RNA, 18 nt, Human
ugacaucaucccaccacc

SEQ ID NO: 1381726 - RNA, 21 nt, Human
ugacuugggaauccaaaaguc

SEQ ID NO: 1381727 - RNA, 23 nt, Human
ugagacuagaaacaguaaagugc

SEQ ID NO: 1381728 - RNA, 19 nt, Human
ugagagacaggcuuagaau

SEQ ID NO: 1381729 - RNA, 18 nt, Human
ugauaugacaucauccca

SEQ ID NO: 1381730 - RNA, 23 nt, Human
ugauuccucaaaaaaacuccaaa

SEQ ID NO: 1381731 - RNA, 22 nt, Human
ugcacugucaucucaaaaaacc

SEQ ID NO: 1381732 - RNA, 23 nt, Human
ugcacugucaucucaaaaaacca

SEQ ID NO: 1381733 - RNA, 23 nt, Human
ugcacugucaucucaaaaaaccu

SEQ ID NO: 1381734 - RNA, 23 nt, Human
uggcuccuccuaggcaaaaaaaa

SEQ ID NO: 1381735 - RNA, 22 nt, Human
uuaaaauuuuggaaagagagua

SEQ ID NO: 1381736 - RNA, 23 nt, Human
uugagucacagauuuucaacugg

SEQ ID NO: 1381737 - RNA, 23 nt, Human
uuuguucucucucccaaauccuu

SEQ ID NO: 1381738 - RNA, 18 nt, Human
uuuuaaaauuucauucac

SEQ ID NO: 1381739 - RNA, 18 nt, Human
aaagaaauaaagggggcc

SEQ ID NO: 1381740 - RNA, 22 nt, Human
aacaaagcacccccacugugcu

SEQ ID NO: 1381741 - RNA, 24 nt, Human
aaugcacuccagccugggcaacag

SEQ ID NO: 1381742 - RNA, 24 nt, Human
acagaaacaaaguauagagaaaga

SEQ ID NO: 1381743 - RNA, 19 nt, Human
acaguagcucacaccugga

SEQ ID NO: 1381744 - RNA, 18 nt, Human
acagugagacccugucuc

SEQ ID NO: 1381745 - RNA, 30 nt, Human
accuggaauccuagcgcuuugggaggccaa

SEQ ID NO: 1381746 - RNA, 22 nt, Human
acuccagccugggcaacaguga

SEQ ID NO: 1381747 - RNA, 19 nt, Human
acuccaggcccccuuuacc

SEQ ID NO: 1381748 - RNA, 22 nt, Human
agaaagaaauaaagggggccca

SEQ ID NO: 1381749 - RNA, 25 nt, Human
agaaagaaauaaagggggcccaggg

SEQ ID NO: 1381750 - RNA, 21 nt, Human
agcugggcacaguagcucaca

SEQ ID NO: 1381751 - RNA, 20 nt, Human
aggaggcugaggcaggaggg

SEQ ID NO: 1381752 - RNA, 18 nt, Human
aggcaggagggucacuug

SEQ ID NO: 1381753 - RNA, 21 nt, Human
aggcugaggcaggagggucac

SEQ ID NO: 1381754 - RNA, 24 nt, Human
aggcugaggcaggagggucacuug

SEQ ID NO: 1381755 - RNA, 24 nt, Human
aguagcucacaccuggaauccuag

SEQ ID NO: 1381756 - RNA, 24 nt, Human
aucacaucaaugcacuccagccug

SEQ ID NO: 1381757 - RNA, 18 nt, Human
augcacuccagccugggc

SEQ ID NO: 1381758 - RNA, 20 nt, Human
caacaaagcacccccacugu

SEQ ID NO: 1381759 - RNA, 20 nt, Human
caacagugagacccugucuc

SEQ ID NO: 1381760 - RNA, 23 nt, Human
caacuccaggcccccuuuacccc

SEQ ID NO: 1381761 - RNA, 19 nt, Human
caaugcacuccagccuggg

SEQ ID NO: 1381762 - RNA, 22 nt, Human
caaugcacuccagccugggcaa

SEQ ID NO: 1381763 - RNA, 23 nt, Human
caaugcacuccagccugggcaac

SEQ ID NO: 1381764 - RNA, 24 nt, Human
caaugcacuccagccugggcaaca

SEQ ID NO: 1381765 - RNA, 24 nt, Human
cacaccuggaauccuagcgcuuug

SEQ ID NO: 1381766 - RNA, 21 nt, Human
cacagaucacgcaacacacag

SEQ ID NO: 1381767 - RNA, 26 nt, Human
cacaucaaugcacuccagccugggca

SEQ ID NO: 1381768 - RNA, 22 nt, Human
caccaagaccccaucucuacaa

SEQ ID NO: 1381769 - RNA, 23 nt, Human
caccaagaccccaucucuacaaa

SEQ ID NO: 1381770 - RNA, 25 nt, Human
caccaagaccccaucucuacaaaaa

SEQ ID NO: 1381771 - RNA, 21 nt, Human
cacccugaugcccccaucugg

SEQ ID NO: 1381772 - RNA, 24 nt, Human
caccuggaauccuagcgcuuuggg

SEQ ID NO: 1381773 - RNA, 21 nt, Human
caccuguaguccccaggaggg

SEQ ID NO: 1381774 - RNA, 22 nt, Human
cacgcaacacacaggaagacac

SEQ ID NO: 1381775 - RNA, 20 nt, Human
cacuccagccugggcaacag

SEQ ID NO: 1381776 - RNA, 21 nt, Human
cacuccagccugggcaacagu

SEQ ID NO: 1381777 - RNA, 22 nt, Human
cacuccagccugggcaacagug

SEQ ID NO: 1381778 - RNA, 24 nt, Human
caucaaugcacuccagccugggca

SEQ ID NO: 1381779 - RNA, 25 nt, Human
ccacaguagccuggcagcuaccugu

SEQ ID NO: 1381780 - RNA, 22 nt, Human
ccaucuggagacucucgggaca

SEQ ID NO: 1381781 - RNA, 19 nt, Human
cccacugugcuuggcagcc

SEQ ID NO: 1381782 - RNA, 19 nt, Human
cccagggccacacuggcuu

SEQ ID NO: 1381783 - RNA, 19 nt, Human
cccugucucaaaaaaaaaa

SEQ ID NO: 1381784 - RNA, 25 nt, Human
ccucacccugaugcccccaucugga

SEQ ID NO: 1381785 - RNA, 23 nt, Human
ccugucucaaaaaaaaaaaaaaa

SEQ ID NO: 1381786 - RNA, 24 nt, Human
ccugucucaaaaaaaaaaaaaaaa

SEQ ID NO: 1381787 - RNA, 24 nt, Human
cgagaccagggugaaaaaucugcu

SEQ ID NO: 1381788 - RNA, 24 nt, Human
cucacaccuggaauccuagcgcuu

SEQ ID NO: 1381789 - RNA, 19 nt, Human
cucacccugaugcccccau

SEQ ID NO: 1381790 - RNA, 18 nt, Human
cucaccguguaaggcaau

SEQ ID NO: 1381791 - RNA, 21 nt, Human
gaaaaagacacagaaacaaag

SEQ ID NO: 1381792 - RNA, 19 nt, Human
gagagacuuuggaagagaa

SEQ ID NO: 1381793 - RNA, 23 nt, Human
gagccgggaggucaaggcuguug

SEQ ID NO: 1381794 - RNA, 18 nt, Human
gagucaguggcugccuga

SEQ ID NO: 1381795 - RNA, 24 nt, Human
gauugcuuaagacuaggaguuuga

SEQ ID NO: 1381796 - RNA, 20 nt, Human
gcccaagucuuggucuggaa

SEQ ID NO: 1381797 - RNA, 18 nt, Human
gcgcuuugggaggccaaa

SEQ ID NO: 1381798 - RNA, 21 nt, Human
gcuguuguaagcuaagaucac

SEQ ID NO: 1381799 - RNA, 23 nt, Human
ggaacgagagacuuuggaagaga

SEQ ID NO: 1381800 - RNA, 20 nt, Human
ggcacaguagcucacaccug

SEQ ID NO: 1381801 - RNA, 23 nt, Human
ggguacucaggaggcugaggcag

SEQ ID NO: 1381802 - RNA, 24 nt, Human
ggguaugguagcacgcaccuguag

SEQ ID NO: 1381803 - RNA, 19 nt, Human
gucuuggucuggaagcacu

SEQ ID NO: 1381804 - RNA, 20 nt, Human
uaaagggggcccaggggacc

SEQ ID NO: 1381805 - RNA, 21 nt, Human
uagcgcuuugggaggccaaag

SEQ ID NO: 1381806 - RNA, 24 nt, Human
uagcgcuuugggaggccaaagcag

SEQ ID NO: 1381807 - RNA, 19 nt, Human
uauucccaaguucuugcuu

SEQ ID NO: 1381808 - RNA, 21 nt, Human
ucaaugcacuccagccugggc

SEQ ID NO: 1381809 - RNA, 24 nt, Human
ucaaugcacuccagccugggcaac

SEQ ID NO: 1381810 - RNA, 22 nt, Human
ucacuugagccgggaggucaag

SEQ ID NO: 1381811 - RNA, 19 nt, Human
uccaacaaagcacccccac

SEQ ID NO: 1381812 - RNA, 22 nt, Human
uccagccugggcaacagugaga

SEQ ID NO: 1381813 - RNA, 18 nt, Human
ucccaaguucuugcuucu

SEQ ID NO: 1381814 - RNA, 18 nt, Human
ucccaaguucuugcuucu

SEQ ID NO: 1381815 - RNA, 21 nt, Human
ucccaaguucuugcuucuuuu

SEQ ID NO: 1381816 - RNA, 26 nt, Human
ucuccacaguagccuggcagcuaccu

SEQ ID NO: 1381817 - RNA, 23 nt, Human
ucuggaagcacuggggcccugga

SEQ ID NO: 1381818 - RNA, 18 nt, Human
ucuguggucagagggaga

SEQ ID NO: 1381819 - RNA, 19 nt, Human
ugagagggguaaucucugg

SEQ ID NO: 1381820 - RNA, 21 nt, Human
ugaggagucuguggucagagg

SEQ ID NO: 1381821 - RNA, 21 nt, Human
ugaggagucuguggucagagg

SEQ ID NO: 1381822 - RNA, 20 nt, Human
ugaggcaggagggucacuug

SEQ ID NO: 1381823 - RNA, 22 nt, Human
uggaagagaaaaagacacagaa

SEQ ID NO: 1381824 - RNA, 21 nt, Human
uggcccaagucuuggucugga

SEQ ID NO: 1381825 - RNA, 21 nt, Human
ugggacgaugacccaagaguc

SEQ ID NO: 1381826 - RNA, 22 nt, Human
ugggcaacagugagacccuguc

SEQ ID NO: 1381827 - RNA, 23 nt, Human
uggggcccuggacccaggcacug

SEQ ID NO: 1381828 - RNA, 27 nt, Human
uggggcccuggacccaggcacugaguu

SEQ ID NO: 1381829 - RNA, 21 nt, Human
ugucuuuaaagccaagugcca

SEQ ID NO: 1381830 - RNA, 22 nt, Human
uuagcuggguaugguagcacgc

SEQ ID NO: 1381831 - RNA, 18 nt, Human
uugaacaacuggcguguc

SEQ ID NO: 1381832 - RNA, 22 nt, Human
aaccccugggcacaagcaaucc

SEQ ID NO: 1381833 - RNA, 25 nt, Human
aagcaauccucccacgucagccucc

SEQ ID NO: 1381834 - RNA, 18 nt, Human
agccuccugaauagcugg

SEQ ID NO: 1381835 - RNA, 24 nt, Human
agguucucugucgcccaggcugga

SEQ ID NO: 1381836 - RNA, 24 nt, Human
agugcagugguaugaucacagcuc

SEQ ID NO: 1381837 - RNA, 24 nt, Human
agugguaugaucacagcucacugc

SEQ ID NO: 1381838 - RNA, 20 nt, Human
auuuauuuuucauuuuccuu

SEQ ID NO: 1381839 - RNA, 24 nt, Human
caaccccugggcacaagcaauccu

SEQ ID NO: 1381840 - RNA, 22 nt, Human
caagcaauccucccacgucagc

SEQ ID NO: 1381841 - RNA, 27 nt, Human
caagcaauccucccacgucagccuccu

SEQ ID NO: 1381842 - RNA, 24 nt, Human
cacgucagccuccugaauagcugg

SEQ ID NO: 1381843 - RNA, 21 nt, Human
cacugaccacggaacaccuuc

SEQ ID NO: 1381844 - RNA, 19 nt, Human
ccaggagccgcuggggagg

SEQ ID NO: 1381845 - RNA, 18 nt, Human
cccagcuuuuuuuuuuuu

SEQ ID NO: 1381846 - RNA, 20 nt, Human
cccaggcuggagugcagugg

SEQ ID NO: 1381847 - RNA, 21 nt, Human
ccucacugaccacggaacacc

SEQ ID NO: 1381848 - RNA, 24 nt, Human
ccucccacgucagccuccugaaua

SEQ ID NO: 1381849 - RNA, 19 nt, Human
ccuucagcucucugcuggc

SEQ ID NO: 1381850 - RNA, 21 nt, Human
cgccucugcuuggcucagcuu

SEQ ID NO: 1381851 - RNA, 19 nt, Human
cgucagccuccugaauagc

SEQ ID NO: 1381852 - RNA, 24 nt, Human
cuccugaauagcugggacaacagg

SEQ ID NO: 1381853 - RNA, 18 nt, Human
cucugucgcccaggcugg

SEQ ID NO: 1381854 - RNA, 19 nt, Human
cucugucgcccaggcugga

SEQ ID NO: 1381855 - RNA, 21 nt, Human
cugcaccacuguguccaggga

SEQ ID NO: 1381856 - RNA, 20 nt, Human
cuucgugcagagccagugcc

SEQ ID NO: 1381857 - RNA, 18 nt, Human
gagugcagugguaugauc

SEQ ID NO: 1381858 - RNA, 24 nt, Human
gagugcagugguaugaucacagcu

SEQ ID NO: 1381859 - RNA, 21 nt, Human
gcaauccucccacgucagccu

SEQ ID NO: 1381860 - RNA, 23 nt, Human
gcccagcuuuuuuuuuuuuuuuu

SEQ ID NO: 1381861 - RNA, 20 nt, Human
gcccaggcuggagugcagug

SEQ ID NO: 1381862 - RNA, 21 nt, Human
ggacaaguguccugggcucuc

SEQ ID NO: 1381863 - RNA, 18 nt, Human
ggcccuggaggaggagcu

SEQ ID NO: 1381864 - RNA, 21 nt, Human
gugugcaccaccaugcccagc

SEQ ID NO: 1381865 - RNA, 22 nt, Human
guucucugucgcccaggcugga

SEQ ID NO: 1381866 - RNA, 24 nt, Human
guucucugucgcccaggcuggagu

SEQ ID NO: 1381867 - RNA, 23 nt, Human
ucacugcagccugcaaccccugg

SEQ ID NO: 1381868 - RNA, 24 nt, Human
ucacugcagccugcaaccccuggg

SEQ ID NO: 1381869 - RNA, 22 nt, Human
ucgcccaggcuggagugcagug

SEQ ID NO: 1381870 - RNA, 19 nt, Human
ucucugucgcccaggcugg

SEQ ID NO: 1381871 - RNA, 25 nt, Human
ucucugucgcccaggcuggagugca

SEQ ID NO: 1381872 - RNA, 24 nt, Human
ucugucgcccaggcuggagugcag

SEQ ID NO: 1381873 - RNA, 19 nt, Human
ugaggagaucuucgugcag

SEQ ID NO: 1381874 - RNA, 19 nt, Human
uggagugcagugguaugau

SEQ ID NO: 1381875 - RNA, 19 nt, Human
uggagugcagugguaugau

SEQ ID NO: 1381876 - RNA, 28 nt, Human
uggagugcagugguaugauggcucuagc

SEQ ID NO: 1381877 - RNA, 24 nt, Human
ugguaugaucacagcucacugcag

SEQ ID NO: 1381878 - RNA, 21 nt, Human
uguccugggcucuccgugggg

SEQ ID NO: 1381879 - RNA, 27 nt, Human
uguccugggcucuccguggggagcugg

SEQ ID NO: 1381880 - RNA, 24 nt, Human
uucucugucgcccaggcuggagug

SEQ ID NO: 1381881 - RNA, 19 nt, Human
uuggcccaagcauggcugc

SEQ ID NO: 1381882 - RNA, 21 nt, Human
uuuuuagagagguucucuguc

SEQ ID NO: 1381883 - RNA, 29 nt, Human
uuuuuuuuuuuuucuuguagcgauagggg

SEQ ID NO: 1381884 - RNA, 18 nt, Human
uuuuuuuuuuuuuucuug

SEQ ID NO: 1381885 - RNA, 19 nt, Human
uuuuuuuuuuuuuucuugu

SEQ ID NO: 1381886 - RNA, 22 nt, Human
aaaaaaaaaaaaagaaagaaag

SEQ ID NO: 1381887 - RNA, 22 nt, Human
aaaaaaaaaaaagaaagaaaga

SEQ ID NO: 1381888 - RNA, 23 nt, Human
aaaaaaaaaagaaagaaagaaag

SEQ ID NO: 1381889 - RNA, 25 nt, Human
aaaaaaaaaagaaagaaagaaagaa

SEQ ID NO: 1381890 - RNA, 30 nt, Human
aaaagaaagaaagaaagaaagaaacagggg

SEQ ID NO: 1381891 - RNA, 27 nt, Human
aaaugacccucuugccucggccuccca

SEQ ID NO: 1381892 - RNA, 23 nt, Human
aaauugcugggauuauaggcaug

SEQ ID NO: 1381893 - RNA, 18 nt, Human
aacacagugaaaccccgc

SEQ ID NO: 1381894 - RNA, 20 nt, Human
aacacagugaaaccccgccu

SEQ ID NO: 1381895 - RNA, 21 nt, Human
aacacagugaaaccccgccuc

SEQ ID NO: 1381896 - RNA, 21 nt, Human
aagaaagaaagaaagaaagaa

SEQ ID NO: 1381897 - RNA, 18 nt, Human
aagaaggccccacagaug

SEQ ID NO: 1381898 - RNA, 18 nt, Human
aagcuggcugggccaaag

SEQ ID NO: 1381899 - RNA, 18 nt, Human
aaggaggcaaaagaccua

SEQ ID NO: 1381900 - RNA, 19 nt, Human
aaggccucaaauacuccuc

SEQ ID NO: 1381901 - RNA, 21 nt, Human
aagggccagacagaccaacag

SEQ ID NO: 1381902 - RNA, 18 nt, Human
aaugacccucuugccucg

SEQ ID NO: 1381903 - RNA, 25 nt, Human
aaugacccucuugccucggccuccc

SEQ ID NO: 1381904 - RNA, 22 nt, Human
acacaugcaggugccccugggc

SEQ ID NO: 1381905 - RNA, 24 nt, Human
accccgccucuacuaaaaauacaa

SEQ ID NO: 1381906 - RNA, 22 nt, Human
acgccacugcacuccagccugg

SEQ ID NO: 1381907 - RNA, 24 nt, Human
acgccacugcacuccagccugggc

SEQ ID NO: 1381908 - RNA, 19 nt, Human
acucacuguagccuuaccu

SEQ ID NO: 1381909 - RNA, 24 nt, Human
acuccagccugggcgccagaacaa

SEQ ID NO: 1381910 - RNA, 18 nt, Human
acugaagcugccgucccc

SEQ ID NO: 1381911 - RNA, 19 nt, Human
acugcacuccagccugggc

SEQ ID NO: 1381912 - RNA, 24 nt, Human
acugcacuccagccugggcgccag

SEQ ID NO: 1381913 - RNA, 21 nt, Human
acuggacauggguguggaagc

SEQ ID NO: 1381914 - RNA, 19 nt, Human
agacucaaggcaggggugg

SEQ ID NO: 1381915 - RNA, 21 nt, Human
agacucaaggcaggggugggg

SEQ ID NO: 1381916 - RNA, 24 nt, Human
agcacuuugggaggcugagauggg

SEQ ID NO: 1381917 - RNA, 19 nt, Human
agcaggaggcuggguguuc

SEQ ID NO: 1381918 - RNA, 24 nt, Human
agccugggcgccagaacaagacuc

SEQ ID NO: 1381919 - RNA, 20 nt, Human
agcugggcaugguggugggc

SEQ ID NO: 1381920 - RNA, 21 nt, Human
aggaggcaaaagaccuaaaac

SEQ ID NO: 1381921 - RNA, 18 nt, Human
aggcaggagaauggugug

SEQ ID NO: 1381922 - RNA, 22 nt, Human
aggcaggagaauggugugaacc

SEQ ID NO: 1381923 - RNA, 24 nt, Human
aggcaggagaauggugugaacccg

SEQ ID NO: 1381924 - RNA, 21 nt, Human
aggcaggauacagaggccaag

SEQ ID NO: 1381925 - RNA, 22 nt, Human
aggcaggauacagaggccaaga

SEQ ID NO: 1381926 - RNA, 19 nt, Human
aggcagggguggggcaagg

SEQ ID NO: 1381927 - RNA, 24 nt, Human
aggcagggguggggcaaggcagga

SEQ ID NO: 1381928 - RNA, 24 nt, Human
aggcgagguggcucaugccuguaa

SEQ ID NO: 1381929 - RNA, 23 nt, Human
aggcuggguguucugggcccugc

SEQ ID NO: 1381930 - RNA, 24 nt, Human
agguggagcuugcagugagccaag

SEQ ID NO: 1381931 - RNA, 24 nt, Human
aucacgccacugcacuccagccug

SEQ ID NO: 1381932 - RNA, 25 nt, Human
aucaugagaucaagagaucgagacc

SEQ ID NO: 1381933 - RNA, 23 nt, Human
augcaggugccccugggccucac

SEQ ID NO: 1381934 - RNA, 19 nt, Human
augccuguaaucccagcac

SEQ ID NO: 1381935 - RNA, 18 nt, Human
auggccuucuucuguucc

SEQ ID NO: 1381936 - RNA, 20 nt, Human
augggguuuucccauguugg

SEQ ID NO: 1381937 - RNA, 24 nt, Human
caaaaaaaaaaaaaaaagaaagaa

SEQ ID NO: 1381938 - RNA, 24 nt, Human
caaauugcugggauuauaggcaug

SEQ ID NO: 1381939 - RNA, 18 nt, Human
caagaaagaguaacugug

SEQ ID NO: 1381940 - RNA, 21 nt, Human
caagaccagaucugaagcugg

SEQ ID NO: 1381941 - RNA, 21 nt, Human
caagacuccaucucaaaaaaa

SEQ ID NO: 1381942 - RNA, 24 nt, Human
caagaucacgccacugcacuccag

SEQ ID NO: 1381943 - RNA, 22 nt, Human
caccaccacgcccagcuaauuu

SEQ ID NO: 1381944 - RNA, 24 nt, Human
caccacgcccagcuaauuuuugua

SEQ ID NO: 1381945 - RNA, 24 nt, Human
caccucagccucccaaguaacugg

SEQ ID NO: 1381946 - RNA, 18 nt, Human
cacugcacuccagccugg

SEQ ID NO: 1381947 - RNA, 19 nt, Human
cacugcacuccagccuggg

SEQ ID NO: 1381948 - RNA, 20 nt, Human
cacugcacuccagccugggc

SEQ ID NO: 1381949 - RNA, 27 nt, Human
cacugcacuccagccugggcgccagaa

SEQ ID NO: 1381950 - RNA, 21 nt, Human
cagaugccugcagcuccugcu

SEQ ID NO: 1381951 - RNA, 24 nt, Human
cagcacuuugggaggcugagaugg

SEQ ID NO: 1381952 - RNA, 28 nt, Human
cagcacuuugggaggcugagaugggcgg

SEQ ID NO: 1381953 - RNA, 18 nt, Human
cagcccuucaggcugggg

SEQ ID NO: 1381954 - RNA, 19 nt, Human
cagcugaggcggcagcggc

SEQ ID NO: 1381955 - RNA, 22 nt, Human
cagggugggcuccagggcugcc

SEQ ID NO: 1381956 - RNA, 23 nt, Human
caucuguagucccagcuacucgg

SEQ ID NO: 1381957 - RNA, 24 nt, Human
caugccuguaaucccagcacuuug

SEQ ID NO: 1381958 - RNA, 24 nt, Human
cauguuggccaagcugguuucgaa

SEQ ID NO: 1381959 - RNA, 18 nt, Human
ccaaauugcugggauuau

SEQ ID NO: 1381960 - RNA, 24 nt, Human
ccaaauugcugggauuauaggcau

SEQ ID NO: 1381961 - RNA, 19 nt, Human
ccaaguaacugguacaggc

SEQ ID NO: 1381962 - RNA, 22 nt, Human
ccaccccugccuauacacaugc

SEQ ID NO: 1381963 - RNA, 20 nt, Human
ccacugcacuccagccuggg

SEQ ID NO: 1381964 - RNA, 20 nt, Human
ccacugcacuccagccuggg

SEQ ID NO: 1381965 - RNA, 21 nt, Human
ccacugcacuccagccugggc

SEQ ID NO: 1381966 - RNA, 21 nt, Human
ccacugcacuccagccugggc

SEQ ID NO: 1381967 - RNA, 22 nt, Human
ccacugcacuccagccugggcg

SEQ ID NO: 1381968 - RNA, 23 nt, Human
ccacugcacuccagccugggcgc

SEQ ID NO: 1381969 - RNA, 19 nt, Human
ccagagccuacucggugac

SEQ ID NO: 1381970 - RNA, 21 nt, Human
ccagccuugcggaagagcuga

SEQ ID NO: 1381971 - RNA, 24 nt, Human
ccagggcucaaucaaucccuucuc

SEQ ID NO: 1381972 - RNA, 19 nt, Human
ccauguuggccaagcuggu

SEQ ID NO: 1381973 - RNA, 23 nt, Human
ccauguuggccaagcugguuucg

SEQ ID NO: 1381974 - RNA, 18 nt, Human
ccccaagggccgcugccu

SEQ ID NO: 1381975 - RNA, 19 nt, Human
ccccagggaauaccagccu

SEQ ID NO: 1381976 - RNA, 20 nt, Human
ccccugggccucaccucagg

SEQ ID NO: 1381977 - RNA, 24 nt, Human
ccccugggccucaccucagguguc

SEQ ID NO: 1381978 - RNA, 19 nt, Human
cccgugcagccccuucagc

SEQ ID NO: 1381979 - RNA, 18 nt, Human
cccuggccuuaagggcuc

SEQ ID NO: 1381980 - RNA, 22 nt, Human
cccuggggcugcacugaagcuc

SEQ ID NO: 1381981 - RNA, 22 nt, Human
ccuauacacaugcaggugcccc

SEQ ID NO: 1381982 - RNA, 18 nt, Human
ccucaaauacuccucuuc

SEQ ID NO: 1381983 - RNA, 19 nt, Human
ccucgaggucgaagguagg

SEQ ID NO: 1381984 - RNA, 24 nt, Human
ccugcagcuccugcuccauggccu

SEQ ID NO: 1381985 - RNA, 26 nt, Human
ccugcuccauggccuucuucuguucc

SEQ ID NO: 1381986 - RNA, 19 nt, Human
ccugcuccguguccucacc

SEQ ID NO: 1381987 - RNA, 23 nt, Human
ccuggcuaacacagugaaacccc

SEQ ID NO: 1381988 - RNA, 24 nt, Human
ccuggcuaacacagugaaaccccg

SEQ ID NO: 1381989 - RNA, 18 nt, Human
ccugggcccaaaugaccc

SEQ ID NO: 1381990 - RNA, 21 nt, Human
ccuggggcugcacugaagcug

SEQ ID NO: 1381991 - RNA, 22 nt, Human
ccuuacgcacaugggccucccc

SEQ ID NO: 1381992 - RNA, 23 nt, Human
ccuuacgcacaugggccuccccg

SEQ ID NO: 1381993 - RNA, 26 nt, Human
ccuuccgcugcuuaaaauccucugac

SEQ ID NO: 1381994 - RNA, 24 nt, Human
cgagaccauccuggcuaacacagu

SEQ ID NO: 1381995 - RNA, 24 nt, Human
cgccaaguauacuacccaccuccu

SEQ ID NO: 1381996 - RNA, 26 nt, Human
cgccacugcacuccagccugggcgcc

SEQ ID NO: 1381997 - RNA, 22 nt, Human
cgccagaacaagacuccaucuc

SEQ ID NO: 1381998 - RNA, 20 nt, Human
cggaagagcugaguuuggca

SEQ ID NO: 1381999 - RNA, 21 nt, Human
cggccacucagcuccagacac

SEQ ID NO: 1382000 - RNA, 24 nt, Human
cggccaggcgagguggcucaugcc

SEQ ID NO: 1382001 - RNA, 29 nt, Human
cgggagguggagcuugcagugacaacggu

SEQ ID NO: 1382002 - RNA, 24 nt, Human
cgggagguggagcuugcagugagc

SEQ ID NO: 1382003 - RNA, 23 nt, Human
cgugcaccaccacgcccagcuaa

SEQ ID NO: 1382004 - RNA, 25 nt, Human
cucaaaaaaaaaaaaaaaagaaaga

SEQ ID NO: 1382005 - RNA, 21 nt, Human
cucaaggcagggguggggcaa

SEQ ID NO: 1382006 - RNA, 19 nt, Human
cucaccucagccucccaag

SEQ ID NO: 1382007 - RNA, 24 nt, Human
cucaugccuguaaucccagcacuu

SEQ ID NO: 1382008 - RNA, 19 nt, Human
cuccaucucaaaaaaaaaa

SEQ ID NO: 1382009 - RNA, 18 nt, Human
cuccugucucacaauccc

SEQ ID NO: 1382010 - RNA, 20 nt, Human
cucuacuaaaaauacaaaaa

SEQ ID NO: 1382011 - RNA, 26 nt, Human
cugccaggccuuuguggaggccuggg

SEQ ID NO: 1382012 - RNA, 23 nt, Human
cugccuggacaagaaagaguaac

SEQ ID NO: 1382013 - RNA, 18 nt, Human
cuggaaugagaccucugu

SEQ ID NO: 1382014 - RNA, 18 nt, Human
cuggcuaacacagugaaa

SEQ ID NO: 1382015 - RNA, 21 nt, Human
cuguagucccagcuacucggg

SEQ ID NO: 1382016 - RNA, 27 nt, Human
cuuaaaauccucugacacaggcuaccc

SEQ ID NO: 1382017 - RNA, 20 nt, Human
cuugccucggccucccaaau

SEQ ID NO: 1382018 - RNA, 19 nt, Human
gaaaccccgccucuacuaa

SEQ ID NO: 1382019 - RNA, 22 nt, Human
gagagacacaagaaggccccac

SEQ ID NO: 1382020 - RNA, 18 nt, Human
gagcuugcagugagccaa

SEQ ID NO: 1382021 - RNA, 22 nt, Human
gagcuugcagugagccaagauc

SEQ ID NO: 1382022 - RNA, 18 nt, Human
gaggcaaaagaccuaaaa

SEQ ID NO: 1382023 - RNA, 20 nt, Human
gccaagaucacgccacugca

SEQ ID NO: 1382024 - RNA, 22 nt, Human
gccacugcacuccagccugggc

SEQ ID NO: 1382025 - RNA, 21 nt, Human
gccagaacaagacuccaucuc

SEQ ID NO: 1382026 - RNA, 21 nt, Human
gccucaaauacuccucuucca

SEQ ID NO: 1382027 - RNA, 24 nt, Human
gcuccagaggaggugcaggcaggc

SEQ ID NO: 1382028 - RNA, 18 nt, Human
gcuggguguucugggccc

SEQ ID NO: 1382029 - RNA, 20 nt, Human
gcugugcuuugucugggucc

SEQ ID NO: 1382030 - RNA, 23 nt, Human
ggagaaaggccaaaggcuuugau

SEQ ID NO: 1382031 - RNA, 18 nt, Human
ggagcaggaggcugggug

SEQ ID NO: 1382032 - RNA, 20 nt, Human
ggagcuugcagugagccaag

SEQ ID NO: 1382033 - RNA, 24 nt, Human
ggagcuugcagugagccaagauca

SEQ ID NO: 1382034 - RNA, 22 nt, Human
ggaucaugagaucaagagaucg

SEQ ID NO: 1382035 - RNA, 24 nt, Human
ggauuauaggcaugcaccaucaug

SEQ ID NO: 1382036 - RNA, 20 nt, Human
ggcaaggggguggggcaagg

SEQ ID NO: 1382037 - RNA, 23 nt, Human
ggcccaaaugacccucuugccuc

SEQ ID NO: 1382038 - RNA, 21 nt, Human
ggccugggaggagaaaggcca

SEQ ID NO: 1382039 - RNA, 21 nt, Human
ggcucaugccuguaaucccag

SEQ ID NO: 1382040 - RNA, 18 nt, Human
ggcuggggcuuggggugc

SEQ ID NO: 1382041 - RNA, 22 nt, Human
gggcaagggccagacagaccaa

SEQ ID NO: 1382042 - RNA, 22 nt, Human
gggcccaaaugacccucuugcc

SEQ ID NO: 1382043 - RNA, 19 nt, Human
gggcggaucaugagaucaa

SEQ ID NO: 1382044 - RNA, 24 nt, Human
ggggugcugcacuggacaugggug

SEQ ID NO: 1382045 - RNA, 18 nt, Human
gggguuuucccauguugg

SEQ ID NO: 1382046 - RNA, 20 nt, Human
gguccuggcgagagcucgcc

SEQ ID NO: 1382047 - RNA, 23 nt, Human
gguggcucaugccuguaauccca

SEQ ID NO: 1382048 - RNA, 24 nt, Human
gguggcucaugccuguaaucccag

SEQ ID NO: 1382049 - RNA, 21 nt, Human
ggugggcuccagggcugccuc

SEQ ID NO: 1382050 - RNA, 25 nt, Human
guaaaggaaggaggcaaaagaccua

SEQ ID NO: 1382051 - RNA, 21 nt, Human
guagagaugggguuuucccau

SEQ ID NO: 1382052 - RNA, 22 nt, Human
guagagaugggguuuucccaug

SEQ ID NO: 1382053 - RNA, 23 nt, Human
guggcucaugccuguaaucccag

SEQ ID NO: 1382054 - RNA, 18 nt, Human
guguguacaagugugggg

SEQ ID NO: 1382055 - RNA, 18 nt, Human
guguucugggcccugcuc

SEQ ID NO: 1382056 - RNA, 21 nt, Human
guuggcccuggccuuaagggc

SEQ ID NO: 1382057 - RNA, 19 nt, Human
guuuugguagagauggggu

SEQ ID NO: 1382058 - RNA, 27 nt, Human
uaauuuuuguauuuguuuugguagaga

SEQ ID NO: 1382059 - RNA, 24 nt, Human
uacaggcgugcaccaccacgccca

SEQ ID NO: 1382060 - RNA, 24 nt, Human
uacuguugugguuuaccugugguu

SEQ ID NO: 1382061 - RNA, 23 nt, Human
uauuuuugaaacagggucggcca

SEQ ID NO: 1382062 - RNA, 23 nt, Human
ucacgccacugcacuccagccug

SEQ ID NO: 1382063 - RNA, 21 nt, Human
ucacuguagccuuaccuucca

SEQ ID NO: 1382064 - RNA, 22 nt, Human
ucaugccuguaaucccagcacu

SEQ ID NO: 1382065 - RNA, 23 nt, Human
uccaucucaaaaaaaaaaaaaaa

SEQ ID NO: 1382066 - RNA, 29 nt, Human
uccaucucaaaaaaaaaaaaaaaagaaaa

SEQ ID NO: 1382067 - RNA, 24 nt, Human
ucccaaauugcugggauuauaggc

SEQ ID NO: 1382068 - RNA, 21 nt, Human
ucccagcaccucaagauccau

SEQ ID NO: 1382069 - RNA, 30 nt, Human
uccccagcgguggguagccgacuggccucc

SEQ ID NO: 1382070 - RNA, 20 nt, Human
uccccagggaauaccagccu

SEQ ID NO: 1382071 - RNA, 23 nt, Human
ucccuucucaccucagccuccca

SEQ ID NO: 1382072 - RNA, 19 nt, Human
uccugggcccaaaugaccc

SEQ ID NO: 1382073 - RNA, 21 nt, Human
uccugggcccaaaugacccuc

SEQ ID NO: 1382074 - RNA, 18 nt, Human
uccuucaguccacccugc

SEQ ID NO: 1382075 - RNA, 18 nt, Human
uccuugucuccaccccug

SEQ ID NO: 1382076 - RNA, 23 nt, Human
ucggccaggcgagguggcucaug

SEQ ID NO: 1382077 - RNA, 18 nt, Human
ucucaaaaaaaaaaaaaa

SEQ ID NO: 1382078 - RNA, 25 nt, Human
ucucaaaaaaaaaaaaaaaagaaag

SEQ ID NO: 1382079 - RNA, 20 nt, Human
ucugaggcccuguguggagg

SEQ ID NO: 1382080 - RNA, 19 nt, Human
ucugggucccccaggggac

SEQ ID NO: 1382081 - RNA, 21 nt, Human
ucuguagucccagcuacucgg

SEQ ID NO: 1382082 - RNA, 23 nt, Human
ucuugcucugccacccaucauga

SEQ ID NO: 1382083 - RNA, 24 nt, Human
ugaccagcccuucaggcuggggcu

SEQ ID NO: 1382084 - RNA, 24 nt, Human
ugagaugggcggaucaugagauca

SEQ ID NO: 1382085 - RNA, 25 nt, Human
ugaggcccuguguggaggaccccaa

SEQ ID NO: 1382086 - RNA, 26 nt, Human
ugaggcggcagcggcagacaggugcg

SEQ ID NO: 1382087 - RNA, 21 nt, Human
ugaggggugguggucugaucc

SEQ ID NO: 1382088 - RNA, 21 nt, Human
ugcacugaagcugccgucccc

SEQ ID NO: 1382089 - RNA, 18 nt, Human
ugcacuggacaugggugu

SEQ ID NO: 1382090 - RNA, 22 nt, Human
ugcacuggacauggguguggaa

SEQ ID NO: 1382091 - RNA, 21 nt, Human
ugccaggccuuuguggaggcc

SEQ ID NO: 1382092 - RNA, 27 nt, Human
ugcccagacucaaggcagggguggggc

SEQ ID NO: 1382093 - RNA, 21 nt, Human
ugcccggccacucagcuccag

SEQ ID NO: 1382094 - RNA, 26 nt, Human
ugccuauacacaugcaggugccccug

SEQ ID NO: 1382095 - RNA, 18 nt, Human
ugccucggccucccaaau

SEQ ID NO: 1382096 - RNA, 21 nt, Human
ugccucggccucccaaauugc

SEQ ID NO: 1382097 - RNA, 24 nt, Human
ugccucggccucccaaauugcugg

SEQ ID NO: 1382098 - RNA, 23 nt, Human
ugccuguaaucccagcacuuugg

SEQ ID NO: 1382099 - RNA, 24 nt, Human
ugccuguaaucccagcacuuuggg

SEQ ID NO: 1382100 - RNA, 19 nt, Human
ugcugggauuauaggcaug

SEQ ID NO: 1382101 - RNA, 23 nt, Human
ugcuuaaaauccucugacacagg

SEQ ID NO: 1382102 - RNA, 22 nt, Human
uggaagcuggcccuucccuggg

SEQ ID NO: 1382103 - RNA, 23 nt, Human
uggaagcuggcccuucccugggg

SEQ ID NO: 1382104 - RNA, 22 nt, Human
uggaaugagaccucugucugcc

SEQ ID NO: 1382105 - RNA, 21 nt, Human
uggcaagauagugguggggcc

SEQ ID NO: 1382106 - RNA, 22 nt, Human
uggcagaagccagagccuacuc

SEQ ID NO: 1382107 - RNA, 24 nt, Human
uggccaagcugguuucgaauuccu

SEQ ID NO: 1382108 - RNA, 24 nt, Human
uggcucaugccuguaaucccagca

SEQ ID NO: 1382109 - RNA, 24 nt, Human
uggcugggccaaagcagcugaggc

SEQ ID NO: 1382110 - RNA, 19 nt, Human
ugggaccgaugcccggcca

SEQ ID NO: 1382111 - RNA, 19 nt, Human
ugggaggcugagaugggcg

SEQ ID NO: 1382112 - RNA, 24 nt, Human
ugggaggcugagaugggcggauca

SEQ ID NO: 1382113 - RNA, 21 nt, Human
ugggauuauaggcaugcacca

SEQ ID NO: 1382114 - RNA, 22 nt, Human
ugggauuauaggcaugcaccau

SEQ ID NO: 1382115 - RNA, 25 nt, Human
ugggccaaagcagcugaggcggcag

SEQ ID NO: 1382116 - RNA, 18 nt, Human
uggggugggagcaggagg

SEQ ID NO: 1382117 - RNA, 20 nt, Human
uggggugggagcaggaggcu

SEQ ID NO: 1382118 - RNA, 21 nt, Human
uggggugggagcaggaggcug

SEQ ID NO: 1382119 - RNA, 18 nt, Human
uggguguggaagcuggcc

SEQ ID NO: 1382120 - RNA, 24 nt, Human
ugguagagaugggguuuucccaug

SEQ ID NO: 1382121 - RNA, 20 nt, Human
ugguggucugauccuucagu

SEQ ID NO: 1382122 - RNA, 24 nt, Human
ugguggugggcaucuguaguccca

SEQ ID NO: 1382123 - RNA, 28 nt, Human
ugugaggggugguggucugaccgugagg

SEQ ID NO: 1382124 - RNA, 24 nt, Human
uguggaagcuggcccuucccuggg

SEQ ID NO: 1382125 - RNA, 20 nt, Human
uguggaggaccccaagggcc

SEQ ID NO: 1382126 - RNA, 21 nt, Human
uguggaggaccccaagggccg

SEQ ID NO: 1382127 - RNA, 20 nt, Human
uguggcagaagccagagccu

SEQ ID NO: 1382128 - RNA, 23 nt, Human
uguggcagaagccagagccuacu

SEQ ID NO: 1382129 - RNA, 20 nt, Human
ugugguugggagagacacaa

SEQ ID NO: 1382130 - RNA, 18 nt, Human
uuagcucugaaggagaga

SEQ ID NO: 1382131 - RNA, 18 nt, Human
uuagcugggcaugguggu

SEQ ID NO: 1382132 - RNA, 23 nt, Human
uuagcugggcaugguggugggca

SEQ ID NO: 1382133 - RNA, 23 nt, Human
uuaggcaggagaauggugugaac

SEQ ID NO: 1382134 - RNA, 24 nt, Human
uuaggcaggagaauggugugaacc

SEQ ID NO: 1382135 - RNA, 22 nt, Human
uuccaggcagcgcugcagggag

SEQ ID NO: 1382136 - RNA, 22 nt, Human
uuccgcugcuuaaaauccucug

SEQ ID NO: 1382137 - RNA, 20 nt, Human
uugcagugagccaagaucac

SEQ ID NO: 1382138 - RNA, 24 nt, Human
uugguagagaugggguuuucccau

SEQ ID NO: 1382139 - RNA, 20 nt, Human
uuucccauguuggccaagcu

SEQ ID NO: 1382140 - RNA, 23 nt, Human
uuuuuguauuuguuuugguagag

SEQ ID NO: 1382141 - RNA, 26 nt, Human
uuuuuguauuuguuuugguagagaug

SEQ ID NO: 1382142 - RNA, 19 nt, Human
aaaaaaaaaagaaugacaa

SEQ ID NO: 1382143 - RNA, 21 nt, Human
aaaaaaaaaagaaugacaaua

SEQ ID NO: 1382144 - RNA, 22 nt, Human
aaagcaaaugugaauaagaggu

SEQ ID NO: 1382145 - RNA, 20 nt, Human
aacauggugaaacccugucu

SEQ ID NO: 1382146 - RNA, 21 nt, Human
aacauggugaaacccugucuc

SEQ ID NO: 1382147 - RNA, 23 nt, Human
aacgcacuccagccuggcgacag

SEQ ID NO: 1382148 - RNA, 27 nt, Human
aagcaaaugugaauaagagguuuccac

SEQ ID NO: 1382149 - RNA, 21 nt, Human
aaugcuuguugcaagaaugaa

SEQ ID NO: 1382150 - RNA, 24 nt, Human
acagagugagacucugucucaaaa

SEQ ID NO: 1382151 - RNA, 24 nt, Human
acccugucucuacuaaaaauacaa

SEQ ID NO: 1382152 - RNA, 19 nt, Human
accucagaucaugaggcau

SEQ ID NO: 1382153 - RNA, 23 nt, Human
accuguagucccagcuacucagg

SEQ ID NO: 1382154 - RNA, 22 nt, Human
acgcacuccagccuggcgacag

SEQ ID NO: 1382155 - RNA, 23 nt, Human
acuccagccuggcgacagaguga

SEQ ID NO: 1382156 - RNA, 22 nt, Human
agaaucgauugaacccaggagg

SEQ ID NO: 1382157 - RNA, 24 nt, Human
agcacuuugggaggcugaggcggg

SEQ ID NO: 1382158 - RNA, 21 nt, Human
agccuggcgacagagugagac

SEQ ID NO: 1382159 - RNA, 23 nt, Human
agccuggcgacagagugagacuc

SEQ ID NO: 1382160 - RNA, 24 nt, Human
agccuguaaucccagcacuuuggg

SEQ ID NO: 1382161 - RNA, 18 nt, Human
agcuguguaaguuuaaau

SEQ ID NO: 1382162 - RNA, 23 nt, Human
aggcaggagaaucgauugaaccc

SEQ ID NO: 1382163 - RNA, 24 nt, Human
aggcaggagaaucgauugaaccca

SEQ ID NO: 1382164 - RNA, 21 nt, Human
aggcggagguugcagugagcc

SEQ ID NO: 1382165 - RNA, 24 nt, Human
aggcggagguugcagugagccgag

SEQ ID NO: 1382166 - RNA, 24 nt, Human
aggcgggcagaucacgaggucagg

SEQ ID NO: 1382167 - RNA, 18 nt, Human
aggcguggagcucaggag

SEQ ID NO: 1382168 - RNA, 24 nt, Human
aggcugaggcaggagaaucgauug

SEQ ID NO: 1382169 - RNA, 19 nt, Human
aggugcucaauaaaugcuu

SEQ ID NO: 1382170 - RNA, 21 nt, Human
auccuggccaacauggugaaa

SEQ ID NO: 1382171 - RNA, 18 nt, Human
auggaagacaauuuuuuc

SEQ ID NO: 1382172 - RNA, 24 nt, Human
auugugccaacgcacuccagccug

SEQ ID NO: 1382173 - RNA, 18 nt, Human
auuugcccuggagagaac

SEQ ID NO: 1382174 - RNA, 21 nt, Human
caaaagucuaaggucucccca

SEQ ID NO: 1382175 - RNA, 24 nt, Human
caacauggugaaacccugucucua

SEQ ID NO: 1382176 - RNA, 19 nt, Human
cacaccuguagucccagcu

SEQ ID NO: 1382177 - RNA, 22 nt, Human
cacccaccgcucacccccugcu

SEQ ID NO: 1382178 - RNA, 21 nt, Human
cacccccugcuguguggccug

SEQ ID NO: 1382179 - RNA, 24 nt, Human
caccuguagucccagcuacucagg

SEQ ID NO: 1382180 - RNA, 21 nt, Human
cacuccagccuggcgacagag

SEQ ID NO: 1382181 - RNA, 21 nt, Human
cacuccagccuggcgacagag

SEQ ID NO: 1382182 - RNA, 23 nt, Human
cacuccagccuggcgacagagug

SEQ ID NO: 1382183 - RNA, 21 nt, Human
cagaauaucuaccucuacugg

SEQ ID NO: 1382184 - RNA, 24 nt, Human
cagcacuuugggaggcugaggcgg

SEQ ID NO: 1382185 - RNA, 25 nt, Human
cagcgggucccgccccgccacgucu

SEQ ID NO: 1382186 - RNA, 24 nt, Human
cagcuacucaggaggcugaggcag

SEQ ID NO: 1382187 - RNA, 20 nt, Human
caucaguauuuucuguccuu

SEQ ID NO: 1382188 - RNA, 23 nt, Human
caucaguauuuucuguccuuuag

SEQ ID NO: 1382189 - RNA, 22 nt, Human
ccaggaggcggagguugcagug

SEQ ID NO: 1382190 - RNA, 18 nt, Human
cccccugcuguguggccu

SEQ ID NO: 1382191 - RNA, 20 nt, Human
cccccugcuguguggccugg

SEQ ID NO: 1382192 - RNA, 21 nt, Human
cccgccacgucugcagggccg

SEQ ID NO: 1382193 - RNA, 19 nt, Human
cccgccccgccacgucugc

SEQ ID NO: 1382194 - RNA, 18 nt, Human
ccgccccgccacgucugc

SEQ ID NO: 1382195 - RNA, 19 nt, Human
ccgcucacccccugcugug

SEQ ID NO: 1382196 - RNA, 25 nt, Human
ccggccgggcgcgguggcucaagcc

SEQ ID NO: 1382197 - RNA, 22 nt, Human
ccuggccaacauggugaaaccc

SEQ ID NO: 1382198 - RNA, 22 nt, Human
ccuggccaacauggugaaaccc

SEQ ID NO: 1382199 - RNA, 24 nt, Human
ccuggccaacauggugaaacccug

SEQ ID NO: 1382200 - RNA, 21 nt, Human
ccuggcgacagagugagacuc

SEQ ID NO: 1382201 - RNA, 20 nt, Human
ccuguaaucccagcacuuug

SEQ ID NO: 1382202 - RNA, 21 nt, Human
ccuguagucccagcuacucag

SEQ ID NO: 1382203 - RNA, 18 nt, Human
ccuguauggaacaaaggc

SEQ ID NO: 1382204 - RNA, 24 nt, Human
ccuuguucuucaaaguuuuuaagg

SEQ ID NO: 1382205 - RNA, 24 nt, Human
cgagaccauccuggccaacauggu

SEQ ID NO: 1382206 - RNA, 24 nt, Human
cgagauugugccaacgcacuccag

SEQ ID NO: 1382207 - RNA, 22 nt, Human
cggcacgaagcuauucaaccuc

SEQ ID NO: 1382208 - RNA, 22 nt, Human
cgggcagaucacgaggucagga

SEQ ID NO: 1382209 - RNA, 23 nt, Human
cuaaggucuccccaugaguuucu

SEQ ID NO: 1382210 - RNA, 25 nt, Human
cucaaaaaaaaaaaaaaaaaaagaa

SEQ ID NO: 1382211 - RNA, 24 nt, Human
cucaagccuguaaucccagcacuu

SEQ ID NO: 1382212 - RNA, 18 nt, Human
cucacccaccgcucaccc

SEQ ID NO: 1382213 - RNA, 23 nt, Human
cucacucacccaccgcucacccc

SEQ ID NO: 1382214 - RNA, 24 nt, Human
cuccagccuggcgacagagugaga

SEQ ID NO: 1382215 - RNA, 19 nt, Human
cucugucucaaaaaaaaaa

SEQ ID NO: 1382216 - RNA, 18 nt, Human
cugcagggccggcgggga

SEQ ID NO: 1382217 - RNA, 24 nt, Human
cuggccaacauggugaaacccugu

SEQ ID NO: 1382218 - RNA, 18 nt, Human
cuguggccuggggguggg

SEQ ID NO: 1382219 - RNA, 19 nt, Human
gaaacccugucucuacuaa

SEQ ID NO: 1382220 - RNA, 22 nt, Human
gaacacgaauauuuguaaauaa

SEQ ID NO: 1382221 - RNA, 18 nt, Human
gaaggcguggagcucagg

SEQ ID NO: 1382222 - RNA, 22 nt, Human
gaaugaccggccgggcgcggug

SEQ ID NO: 1382223 - RNA, 24 nt, Human
gacagagugagacucugucucaaa

SEQ ID NO: 1382224 - RNA, 23 nt, Human
gagguugcagugagccgagauug

SEQ ID NO: 1382225 - RNA, 22 nt, Human
gcacuccagccuggcgacagag

SEQ ID NO: 1382226 - RNA, 22 nt, Human
gcacuccagccuggcgacagag

SEQ ID NO: 1382227 - RNA, 22 nt, Human
gcaggagaaucgauugaaccca

SEQ ID NO: 1382228 - RNA, 24 nt, Human
gccaacauggugaaacccugucuc

SEQ ID NO: 1382229 - RNA, 23 nt, Human
gccaggcgcacagagaacauccc

SEQ ID NO: 1382230 - RNA, 22 nt, Human
gccagugguccccaaccuuucu

SEQ ID NO: 1382231 - RNA, 24 nt, Human
gcgacagagugagacucugucuca

SEQ ID NO: 1382232 - RNA, 22 nt, Human
gcugggcgugguggcacacacc

SEQ ID NO: 1382233 - RNA, 22 nt, Human
ggaggcggagguugcagugagc

SEQ ID NO: 1382234 - RNA, 22 nt, Human
ggagguugcagugagccgagau

SEQ ID NO: 1382235 - RNA, 24 nt, Human
ggagguugcagugagccgagauug

SEQ ID NO: 1382236 - RNA, 25 nt, Human
ggccaggcgcacagagaacaucccc

SEQ ID NO: 1382237 - RNA, 24 nt, Human
ggccgcagggucuucugugcagcc

SEQ ID NO: 1382238 - RNA, 19 nt, Human
ggcgacagagugagacucu

SEQ ID NO: 1382239 - RNA, 23 nt, Human
ggcgcgguggcucaagccuguaa

SEQ ID NO: 1382240 - RNA, 22 nt, Human
ggcgugguggcacacaccugua

SEQ ID NO: 1382241 - RNA, 21 nt, Human
ggcucaagccuguaaucccag

SEQ ID NO: 1382242 - RNA, 24 nt, Human
gggcagaucacgaggucaggagau

SEQ ID NO: 1382243 - RNA, 20 nt, Human
ggguagcgggaugggggugg

SEQ ID NO: 1382244 - RNA, 23 nt, Human
gguggcucaagccuguaauccca

SEQ ID NO: 1382245 - RNA, 24 nt, Human
gguggcucaagccuguaaucccag

SEQ ID NO: 1382246 - RNA, 19 nt, Human
gugaagcagguguauugua

SEQ ID NO: 1382247 - RNA, 24 nt, Human
guugcagugagccgagauugugcc

SEQ ID NO: 1382248 - RNA, 21 nt, Human
uaaaauauccuuacuuugccu

SEQ ID NO: 1382249 - RNA, 21 nt, Human
uaaauacagaugaagcugugc

SEQ ID NO: 1382250 - RNA, 24 nt, Human
uaaauuaacauaaagaaaacacaa

SEQ ID NO: 1382251 - RNA, 18 nt, Human
uaacaaaacaaaguucag

SEQ ID NO: 1382252 - RNA, 18 nt, Human
uaacucucucuaaauuug

SEQ ID NO: 1382253 - RNA, 24 nt, Human
uaagagguuuccaccuugcaaaac

SEQ ID NO: 1382254 - RNA, 21 nt, Human
uacagaugaagcugugcucac

SEQ ID NO: 1382255 - RNA, 20 nt, Human
uacaguacauagacaaauga

SEQ ID NO: 1382256 - RNA, 19 nt, Human
uaccuguagggauguccau

SEQ ID NO: 1382257 - RNA, 26 nt, Human
uaccuuguucuucaaaguuuuuaagg

SEQ ID NO: 1382258 - RNA, 18 nt, Human
uacuggucuguggccugg

SEQ ID NO: 1382259 - RNA, 20 nt, Human
ucaaaaaaaaaaaaaaaaaa

SEQ ID NO: 1382260 - RNA, 25 nt, Human
ucaaaaaaaaaaaaaaaaaaagaau

SEQ ID NO: 1382261 - RNA, 26 nt, Human
ucaaagcaaaugugaauaagagguuu

SEQ ID NO: 1382262 - RNA, 21 nt, Human
ucacccccugcuguguggccu

SEQ ID NO: 1382263 - RNA, 18 nt, Human
ucacgaggucaggagauc

SEQ ID NO: 1382264 - RNA, 24 nt, Human
ucacgaggucaggagaucgagacc

SEQ ID NO: 1382265 - RNA, 22 nt, Human
uccagccuggcgacagagugag

SEQ ID NO: 1382266 - RNA, 23 nt, Human
uccagccuggcgacagagugaga

SEQ ID NO: 1382267 - RNA, 18 nt, Human
ucccucgcaugugcaguu

SEQ ID NO: 1382268 - RNA, 23 nt, Human
ucccucgcaugugcaguucacaa

SEQ ID NO: 1382269 - RNA, 19 nt, Human
uccuuuagcaacgaugaug

SEQ ID NO: 1382270 - RNA, 25 nt, Human
ucucuacuaaaaauacaaaaaaaau

SEQ ID NO: 1382271 - RNA, 19 nt, Human
ucugcagggccggcgggga

SEQ ID NO: 1382272 - RNA, 23 nt, Human
ucugucucaaaaaaaaaaaaaaa

SEQ ID NO: 1382273 - RNA, 24 nt, Human
ucuguggccaggcgcacagagaac

SEQ ID NO: 1382274 - RNA, 20 nt, Human
ucuguggccugggggugggg

SEQ ID NO: 1382275 - RNA, 21 nt, Human
ucuucugugcagccucccaug

SEQ ID NO: 1382276 - RNA, 22 nt, Human
ugaaacauaaaggauuaaacaa

SEQ ID NO: 1382277 - RNA, 22 nt, Human
ugagccgagauugugccaacgc

SEQ ID NO: 1382278 - RNA, 19 nt, Human
ugaggcaaggcggccagcu

SEQ ID NO: 1382279 - RNA, 20 nt, Human
ugaggcaggagaaucgauug

SEQ ID NO: 1382280 - RNA, 24 nt, Human
ugaggcaggagaaucgauugaacc

SEQ ID NO: 1382281 - RNA, 25 nt, Human
ugaggcaggagaaucgauugaaccc

SEQ ID NO: 1382282 - RNA, 24 nt, Human
ugaggcgggcagaucacgagguca

SEQ ID NO: 1382283 - RNA, 22 nt, Human
uggcacacaccuguagucccag

SEQ ID NO: 1382284 - RNA, 24 nt, Human
uggccaacauggugaaacccuguc

SEQ ID NO: 1382285 - RNA, 21 nt, Human
uggccuggggguggggacccc

SEQ ID NO: 1382286 - RNA, 24 nt, Human
uggcucaagccuguaaucccagca

SEQ ID NO: 1382287 - RNA, 19 nt, Human
uggcugggcgugguggcac

SEQ ID NO: 1382288 - RNA, 19 nt, Human
ugggaggcugaggcgggca

SEQ ID NO: 1382289 - RNA, 20 nt, Human
ugggaggcugaggcgggcag

SEQ ID NO: 1382290 - RNA, 24 nt, Human
ugggaggcugaggcgggcagauca

SEQ ID NO: 1382291 - RNA, 22 nt, Human
uggucuguggccuggggguggg

SEQ ID NO: 1382292 - RNA, 23 nt, Human
uggucuguggccugggggugggg

SEQ ID NO: 1382293 - RNA, 23 nt, Human
ugguggcacacaccuguaguccc

SEQ ID NO: 1382294 - RNA, 24 nt, Human
ugguggcacacaccuguaguccca

SEQ ID NO: 1382295 - RNA, 20 nt, Human
uguaguguccucaaauggau

SEQ ID NO: 1382296 - RNA, 21 nt, Human
uguaguguccucaaauggaug

SEQ ID NO: 1382297 - RNA, 20 nt, Human
uguaucgaacaugcagcugc

SEQ ID NO: 1382298 - RNA, 18 nt, Human
ugucuguggccaggcgca

SEQ ID NO: 1382299 - RNA, 20 nt, Human
ugugcaaaauugcuuguagu

SEQ ID NO: 1382300 - RNA, 21 nt, Human
uuaacauaaagaaaacacaau

SEQ ID NO: 1382301 - RNA, 19 nt, Human
uucagaauaucuaccucua

SEQ ID NO: 1382302 - RNA, 24 nt, Human
uugaacccaggaggcggagguugc

SEQ ID NO: 1382303 - RNA, 18 nt, Human
uugcagugagccgagauu

SEQ ID NO: 1382304 - RNA, 22 nt, Human
uugcagugagccgagauugugc

SEQ ID NO: 1382305 - RNA, 25 nt, Human
uugggaggcugaggcgggcagauca

SEQ ID NO: 1382306 - RNA, 22 nt, Human
accgacgcuggcggagguugcg

SEQ ID NO: 1382307 - RNA, 23 nt, Human
agaggagggaguaaguuguuggg

SEQ ID NO: 1382308 - RNA, 18 nt, Human
agguucuuuauucucccu

SEQ ID NO: 1382309 - RNA, 26 nt, Human
caccaguaacacuuccaggcucccaa

SEQ ID NO: 1382310 - RNA, 21 nt, Human
cacccacaccugcccagggac

SEQ ID NO: 1382311 - RNA, 22 nt, Human
cacccacaccugcccagggacc

SEQ ID NO: 1382312 - RNA, 19 nt, Human
cagcuuccuaaaugucuca

SEQ ID NO: 1382313 - RNA, 22 nt, Human
caucacagaacuucuuccuaga

SEQ ID NO: 1382314 - RNA, 27 nt, Human
caucacagaacuucuuccuagaugggg

SEQ ID NO: 1382315 - RNA, 18 nt, Human
cauuccacccacaccugc

SEQ ID NO: 1382316 - RNA, 18 nt, Human
ccauugggugaacugcuu

SEQ ID NO: 1382317 - RNA, 22 nt, Human
ccuaaaugucucacuccauccc

SEQ ID NO: 1382318 - RNA, 23 nt, Human
ccuucugcuacacugugguaguc

SEQ ID NO: 1382319 - RNA, 20 nt, Human
cgacacacagcagaguucca

SEQ ID NO: 1382320 - RNA, 18 nt, Human
cuugucugcuccaugccc

SEQ ID NO: 1382321 - RNA, 20 nt, Human
gcucccaaaacgacacacag

SEQ ID NO: 1382322 - RNA, 21 nt, Human
guaacacuuccaggcucccaa

SEQ ID NO: 1382323 - RNA, 19 nt, Human
guggauuugguuaccccga

SEQ ID NO: 1382324 - RNA, 22 nt, Human
uccacccacaccugcccaggga

SEQ ID NO: 1382325 - RNA, 24 nt, Human
uccacccacaccugcccagggacc

SEQ ID NO: 1382326 - RNA, 19 nt, Human
ugauauauaggcuacuggg

SEQ ID NO: 1382327 - RNA, 20 nt, Human
ugcccagggaccgacgcugg

SEQ ID NO: 1382328 - RNA, 20 nt, Human
ugcuugucugcuccaugccc

SEQ ID NO: 1382329 - RNA, 20 nt, Human
uggcggagguugcggacagc

SEQ ID NO: 1382330 - RNA, 26 nt, Human
ugguggauuugguuaccccgagguuc

SEQ ID NO: 1382331 - RNA, 23 nt, Human
ugucucacuccaucccugucuau

SEQ ID NO: 1382332 - RNA, 19 nt, Human
uucacacaucacagaacuu

SEQ ID NO: 1382333 - RNA, 19 nt, Human
uuuuuuuuuuuuuuuguuu

SEQ ID NO: 1382334 - RNA, 22 nt, Human
aaaccccgucuccaccaaaaaa

SEQ ID NO: 1382335 - RNA, 20 nt, Human
aacacagcgaaaccccgucu

SEQ ID NO: 1382336 - RNA, 21 nt, Human
aacacagcgaaaccccgucuc

SEQ ID NO: 1382337 - RNA, 25 nt, Human
aauaaauauagaaaauuacauacaa

SEQ ID NO: 1382338 - RNA, 23 nt, Human
aaucaggcagggaggcugcagug

SEQ ID NO: 1382339 - RNA, 24 nt, Human
aaucgcuugaacccgggaggcgga

SEQ ID NO: 1382340 - RNA, 19 nt, Human
aaugaaggaggcugagaga

SEQ ID NO: 1382341 - RNA, 19 nt, Human
acagcgaaaccccgucucc

SEQ ID NO: 1382342 - RNA, 26 nt, Human
acaggucugacaucuguggucccaug

SEQ ID NO: 1382343 - RNA, 18 nt, Human
acugcacuccagccuggg

SEQ ID NO: 1382344 - RNA, 20 nt, Human
agaacuuugggaggcugagg

SEQ ID NO: 1382345 - RNA, 23 nt, Human
agccgggcgugguggcacaugcc

SEQ ID NO: 1382346 - RNA, 24 nt, Human
agccuggccaacacagcgaaaccc

SEQ ID NO: 1382347 - RNA, 26 nt, Human
agcugggacuuucuggaagagguuuu

SEQ ID NO: 1382348 - RNA, 25 nt, Human
agcugggagguggagguuggggacc

SEQ ID NO: 1382349 - RNA, 22 nt, Human
aggcagaggcugcaaucucggc

SEQ ID NO: 1382350 - RNA, 22 nt, Human
aggcagcagaaucgcuugaacc

SEQ ID NO: 1382351 - RNA, 24 nt, Human
aggcagcagaaucgcuugaacccg

SEQ ID NO: 1382352 - RNA, 22 nt, Human
aggcagcugggagguggagguu

SEQ ID NO: 1382353 - RNA, 18 nt, Human
aggcaugcggaucaccug

SEQ ID NO: 1382354 - RNA, 22 nt, Human
aggcaugcggaucaccugaggg

SEQ ID NO: 1382355 - RNA, 22 nt, Human
aggcaugcggaucaccugaggu

SEQ ID NO: 1382356 - RNA, 21 nt, Human
aggcggagguugcggugagcc

SEQ ID NO: 1382357 - RNA, 24 nt, Human
aggcggagguugcggugagccgag

SEQ ID NO: 1382358 - RNA, 24 nt, Human
aggcugaggcagcagaaucgcuug

SEQ ID NO: 1382359 - RNA, 20 nt, Human
aggcugaggcaggagaauca

SEQ ID NO: 1382360 - RNA, 21 nt, Human
agggagagggagaaccuaaau

SEQ ID NO: 1382361 - RNA, 19 nt, Human
agggaggcugcagugagcc

SEQ ID NO: 1382362 - RNA, 21 nt, Human
agggaggcugcagugagccga

SEQ ID NO: 1382363 - RNA, 22 nt, Human
agggaggcugcagugagccgag

SEQ ID NO: 1382364 - RNA, 21 nt, Human
agguggagguuguagcgagcc

SEQ ID NO: 1382365 - RNA, 24 nt, Human
agguggagguuguagcgagccgag

SEQ ID NO: 1382366 - RNA, 19 nt, Human
agucaggcguggcggcgcg

SEQ ID NO: 1382367 - RNA, 22 nt, Human
aucaaguugguuuuuccauugu

SEQ ID NO: 1382368 - RNA, 24 nt, Human
aucaugccacugcacuccagccug

SEQ ID NO: 1382369 - RNA, 22 nt, Human
auccuggcaccucgggaggcca

SEQ ID NO: 1382370 - RNA, 22 nt, Human
augccacugcacuccagccugg

SEQ ID NO: 1382371 - RNA, 19 nt, Human
augccuguaaucccagaac

SEQ ID NO: 1382372 - RNA, 18 nt, Human
auguggcagaaaugggga

SEQ ID NO: 1382373 - RNA, 23 nt, Human
auugugccguugcacuccagccu

SEQ ID NO: 1382374 - RNA, 21 nt, Human
cacacaagauuuauuggggaa

SEQ ID NO: 1382375 - RNA, 18 nt, Human
cacugcacuccagccugg

SEQ ID NO: 1382376 - RNA, 19 nt, Human
cacugcacuccagccuggg

SEQ ID NO: 1382377 - RNA, 21 nt, Human
cacugcacuccagccugggca

SEQ ID NO: 1382378 - RNA, 24 nt, Human
cacugcacuccagccugggcacca

SEQ ID NO: 1382379 - RNA, 20 nt, Human
cacugggcaggcugaggcag

SEQ ID NO: 1382380 - RNA, 24 nt, Human
cacuuuggggggccaaggcaggca

SEQ ID NO: 1382381 - RNA, 18 nt, Human
cagaacuuugggaggcug

SEQ ID NO: 1382382 - RNA, 20 nt, Human
cagaacuuugggaggcugag

SEQ ID NO: 1382383 - RNA, 22 nt, Human
cagacgaugggcggccuggcag

SEQ ID NO: 1382384 - RNA, 21 nt, Human
cagagacgcuccucacuuccc

SEQ ID NO: 1382385 - RNA, 21 nt, Human
cagagacgcuccucacuuucc

SEQ ID NO: 1382386 - RNA, 21 nt, Human
cagcaguacaguccagcuucg

SEQ ID NO: 1382387 - RNA, 24 nt, Human
cagccugaccaauauggagaaacc

SEQ ID NO: 1382388 - RNA, 24 nt, Human
cagcuacucaggaggcugaggcag

SEQ ID NO: 1382389 - RNA, 20 nt, Human
caggaggcugaggcagcaga

SEQ ID NO: 1382390 - RNA, 23 nt, Human
caucagaccacauacaggucuga

SEQ ID NO: 1382391 - RNA, 24 nt, Human
caugccuguaaucccagaacuuug

SEQ ID NO: 1382392 - RNA, 24 nt, Human
caugcggaucaccugagguuggga

SEQ ID NO: 1382393 - RNA, 20 nt, Human
ccacugcacuccagccuggg

SEQ ID NO: 1382394 - RNA, 20 nt, Human
ccacugcacuccagccuggg

SEQ ID NO: 1382395 - RNA, 21 nt, Human
ccacugcacuccagccugggc

SEQ ID NO: 1382396 - RNA, 22 nt, Human
ccacugcacuccagccugggca

SEQ ID NO: 1382397 - RNA, 22 nt, Human
ccacugcacuccagccugggca

SEQ ID NO: 1382398 - RNA, 18 nt, Human
ccucacuuuccagacugg

SEQ ID NO: 1382399 - RNA, 19 nt, Human
ccucgggaggccaaggcug

SEQ ID NO: 1382400 - RNA, 22 nt, Human
ccugaccaauauggagaaaccc

SEQ ID NO: 1382401 - RNA, 22 nt, Human
ccugagguugggaguucgagac

SEQ ID NO: 1382402 - RNA, 22 nt, Human
ccugcaaucgcaggcacugggc

SEQ ID NO: 1382403 - RNA, 23 nt, Human
ccuggccaacacagcgaaacccc

SEQ ID NO: 1382404 - RNA, 24 nt, Human
ccuggccaacacagcgaaaccccg

SEQ ID NO: 1382405 - RNA, 21 nt, Human
ccuguaaucccagcuacucag

SEQ ID NO: 1382406 - RNA, 22 nt, Human
cgagauggcagcaguacagucc

SEQ ID NO: 1382407 - RNA, 24 nt, Human
cgagauugugccguugcacuccag

SEQ ID NO: 1382408 - RNA, 23 nt, Human
cgagccgagaucaugccacugca

SEQ ID NO: 1382409 - RNA, 18 nt, Human
cgcgguuaggagcuggag

SEQ ID NO: 1382410 - RNA, 24 nt, Human
cggaucaccugagguugggaguuc

SEQ ID NO: 1382411 - RNA, 25 nt, Human
cggcacuuuggggggccaaggcagg

SEQ ID NO: 1382412 - RNA, 24 nt, Human
cgggaggcggagguugcggugagc

SEQ ID NO: 1382413 - RNA, 24 nt, Human
cucaugccuguaaucccagaacuu

SEQ ID NO: 1382414 - RNA, 20 nt, Human
cugcagugagccgagauggc

SEQ ID NO: 1382415 - RNA, 18 nt, Human
cuggccaacacagcgaaa

SEQ ID NO: 1382416 - RNA, 21 nt, Human
cugggcaccauugagcacuga

SEQ ID NO: 1382417 - RNA, 19 nt, Human
gaccguggggagagggaga

SEQ ID NO: 1382418 - RNA, 23 nt, Human
gacuccgucugccauccuggcac

SEQ ID NO: 1382419 - RNA, 20 nt, Human
gagaaccaggguggagcugg

SEQ ID NO: 1382420 - RNA, 23 nt, Human
gagaccagccugaccaauaugga

SEQ ID NO: 1382421 - RNA, 19 nt, Human
gagagaaccaggguggagc

SEQ ID NO: 1382422 - RNA, 23 nt, Human
gagaucaugccacugcacuccag

SEQ ID NO: 1382423 - RNA, 21 nt, Human
gagguugcggugagccgagau

SEQ ID NO: 1382424 - RNA, 23 nt, Human
gagguugcggugagccgagauug

SEQ ID NO: 1382425 - RNA, 24 nt, Human
gaucaccugagguugggaguucga

SEQ ID NO: 1382426 - RNA, 22 nt, Human
gcacuuuggggggccaaggcag

SEQ ID NO: 1382427 - RNA, 21 nt, Human
gcagcaguacaguccagcuuc

SEQ ID NO: 1382428 - RNA, 21 nt, Human
gcagcugggagguggagguug

SEQ ID NO: 1382429 - RNA, 22 nt, Human
gccacugcacuccagccugggc

SEQ ID NO: 1382430 - RNA, 18 nt, Human
ggaggcugcagugagccg

SEQ ID NO: 1382431 - RNA, 22 nt, Human
ggaggcugcagugagccgagau

SEQ ID NO: 1382432 - RNA, 24 nt, Human
ggaggcugcagugagccgagaugg

SEQ ID NO: 1382433 - RNA, 22 nt, Human
ggagguugcggugagccgagau

SEQ ID NO: 1382434 - RNA, 24 nt, Human
ggagguugcggugagccgagauug

SEQ ID NO: 1382435 - RNA, 23 nt, Human
ggagguuguagcgagccgagauc

SEQ ID NO: 1382436 - RNA, 24 nt, Human
ggagguuguagcgagccgagauca

SEQ ID NO: 1382437 - RNA, 23 nt, Human
ggaucaccugagguugggaguuc

SEQ ID NO: 1382438 - RNA, 21 nt, Human
ggcacaugccuguaaucccag

SEQ ID NO: 1382439 - RNA, 21 nt, Human
ggccgggugcgguggcucaug

SEQ ID NO: 1382440 - RNA, 23 nt, Human
ggcgugguggcacaugccuguaa

SEQ ID NO: 1382441 - RNA, 21 nt, Human
ggcugcaaucucggcacuuug

SEQ ID NO: 1382442 - RNA, 23 nt, Human
gggaggccaaggcuggcggauca

SEQ ID NO: 1382443 - RNA, 22 nt, Human
gggcagagacgcuccucacuuu

SEQ ID NO: 1382444 - RNA, 22 nt, Human
gggccaaggcaggcagcuggga

SEQ ID NO: 1382445 - RNA, 24 nt, Human
gggugcgguggcucaugccuguaa

SEQ ID NO: 1382446 - RNA, 24 nt, Human
gguggcacaugccuguaaucccag

SEQ ID NO: 1382447 - RNA, 23 nt, Human
gguggcucaugccuguaauccca

SEQ ID NO: 1382448 - RNA, 24 nt, Human
gguggcucaugccuguaaucccag

SEQ ID NO: 1382449 - RNA, 24 nt, Human
guugcggugagccgagauugugcc

SEQ ID NO: 1382450 - RNA, 23 nt, Human
uaaaaauacaaaauuagccgggc

SEQ ID NO: 1382451 - RNA, 18 nt, Human
uagaaaauuacauacaaa

SEQ ID NO: 1382452 - RNA, 22 nt, Human
uagccgggcgugguggcacaug

SEQ ID NO: 1382453 - RNA, 18 nt, Human
ucaccugagguugggagu

SEQ ID NO: 1382454 - RNA, 23 nt, Human
ucagaccacauacaggucugaca

SEQ ID NO: 1382455 - RNA, 23 nt, Human
ucaugccacugcacuccagccug

SEQ ID NO: 1382456 - RNA, 22 nt, Human
ucaugccuguaaucccagaacu

SEQ ID NO: 1382457 - RNA, 21 nt, Human
uccaccaaaaaaauacgaaaa

SEQ ID NO: 1382458 - RNA, 24 nt, Human
ucgcuugaacccgggaggcggagg

SEQ ID NO: 1382459 - RNA, 22 nt, Human
ugagccgagauugugccguugc

SEQ ID NO: 1382460 - RNA, 24 nt, Human
ugaggcagcagaaucgcuugaacc

SEQ ID NO: 1382461 - RNA, 25 nt, Human
ugaggcagcagaaucgcuugaaccc

SEQ ID NO: 1382462 - RNA, 19 nt, Human
ugaggcaggagaaucaggc

SEQ ID NO: 1382463 - RNA, 20 nt, Human
ugaggcaugcggaucaccug

SEQ ID NO: 1382464 - RNA, 21 nt, Human
ugaggcaugcggaucaccuga

SEQ ID NO: 1382465 - RNA, 24 nt, Human
ugaggcaugcggaucaccugaggu

SEQ ID NO: 1382466 - RNA, 23 nt, Human
ugccuguaaucccagaacuuugg

SEQ ID NO: 1382467 - RNA, 23 nt, Human
ugccuguaaucccagaacuuugg

SEQ ID NO: 1382468 - RNA, 24 nt, Human
ugccuguaaucccagaacuuuggg

SEQ ID NO: 1382469 - RNA, 24 nt, Human
ugccuguaaucccagcuacucagg

SEQ ID NO: 1382470 - RNA, 18 nt, Human
uggaagagguuuugggug

SEQ ID NO: 1382471 - RNA, 18 nt, Human
uggaggagagaaccaggg

SEQ ID NO: 1382472 - RNA, 21 nt, Human
uggcacaugccuguaauccca

SEQ ID NO: 1382473 - RNA, 22 nt, Human
uggcacaugccuguaaucccag

SEQ ID NO: 1382474 - RNA, 24 nt, Human
uggcagagacgcuccucacuuccu

SEQ ID NO: 1382475 - RNA, 24 nt, Human
uggccgggugcgguggcucaugcc

SEQ ID NO: 1382476 - RNA, 21 nt, Human
uggcucaugccuguaauccca

SEQ ID NO: 1382477 - RNA, 22 nt, Human
uggcucaugccuguaaucccag

SEQ ID NO: 1382478 - RNA, 24 nt, Human
ugggaggcugaggcaugcggauca

SEQ ID NO: 1382479 - RNA, 24 nt, Human
ugggagguggagguuguagcgagc

SEQ ID NO: 1382480 - RNA, 23 nt, Human
uggggagagggagagggagaggg

SEQ ID NO: 1382481 - RNA, 24 nt, Human
ugguggcacaugccuguaauccca

SEQ ID NO: 1382482 - RNA, 18 nt, Human
uuagccgggcgugguggc

SEQ ID NO: 1382483 - RNA, 20 nt, Human
uuagccgggcgugguggcac

SEQ ID NO: 1382484 - RNA, 24 nt, Human
uuagccgggcgugguggcacaugc

SEQ ID NO: 1382485 - RNA, 20 nt, Human
uuaggagcuggagaccagcc

SEQ ID NO: 1382486 - RNA, 26 nt, Human
uucaauaaauauagaaaauuacauac

SEQ ID NO: 1382487 - RNA, 21 nt, Human
uuccacagagcaguuguuucc

SEQ ID NO: 1382488 - RNA, 24 nt, Human
uugaacccgggaggcggagguugc

SEQ ID NO: 1382489 - RNA, 22 nt, Human
uugcggugagccgagauugugc

SEQ ID NO: 1382490 - RNA, 25 nt, Human
uugggaggcugaggcaugcggauca

SEQ ID NO: 1382491 - RNA, 20 nt, Human
uuguagcgagccgagaucau

SEQ ID NO: 1382492 - RNA, 20 nt, Human
uuuggggggccaaggcaggc

SEQ ID NO: 1382493 - RNA, 18 nt, Human
aaaacccugucaccugcu

SEQ ID NO: 1382494 - RNA, 19 nt, Human
aacacagaaaacagggcca

SEQ ID NO: 1382495 - RNA, 21 nt, Human
aagaacaaacucaauagcacc

SEQ ID NO: 1382496 - RNA, 20 nt, Human
aauccagccacccuguccaa

SEQ ID NO: 1382497 - RNA, 18 nt, Human
accugcuuuauuucugga

SEQ ID NO: 1382498 - RNA, 24 nt, Human
agcaagaucaacaauuuucacugg

SEQ ID NO: 1382499 - RNA, 18 nt, Human
auccagccacccugucca

SEQ ID NO: 1382500 - RNA, 22 nt, Human
caagaucaacaauuuucacugg

SEQ ID NO: 1382501 - RNA, 21 nt, Human
cacccuguccaaacuggaauc

SEQ ID NO: 1382502 - RNA, 25 nt, Human
cagaaaacagggccacuccuuuuaa

SEQ ID NO: 1382503 - RNA, 23 nt, Human
ccccaagggaugggaagcaguaa

SEQ ID NO: 1382504 - RNA, 22 nt, Human
ccuccccuaacaggagcccuag

SEQ ID NO: 1382505 - RNA, 23 nt, Human
gacuacacucgaggcugccccca

SEQ ID NO: 1382506 - RNA, 19 nt, Human
gcccccaagggaugggaag

SEQ ID NO: 1382507 - RNA, 18 nt, Human
ggaaaauauucacuugaa

SEQ ID NO: 1382508 - RNA, 21 nt, Human
gggaaugcugaaacuuccuug

SEQ ID NO: 1382509 - RNA, 18 nt, Human
guaaagggagaagggaaa

SEQ ID NO: 1382510 - RNA, 24 nt, Human
uaaagaacaaacucaauagcacca

SEQ ID NO: 1382511 - RNA, 19 nt, Human
uccaaacuggaaucugauu

SEQ ID NO: 1382512 - RNA, 19 nt, Human
ugauucaacauuucucccu

SEQ ID NO: 1382513 - RNA, 19 nt, Human
ugggguuuuaacacagaaa

SEQ ID NO: 1382514 - RNA, 19 nt, Human
uguccaaacuggaaucuga

SEQ ID NO: 1382515 - RNA, 19 nt, Human
uguuuucccucuugauuca

SEQ ID NO: 1382516 - RNA, 27 nt, Human
uucaacauuucucccuccccuaacagg

SEQ ID NO: 1382517 - RNA, 29 nt, Human
uucaacauuucucccuccccuaacaggag

SEQ ID NO: 1382518 - RNA, 19 nt, Human
uugaauuugaggggcagcu

SEQ ID NO: 1382519 - RNA, 24 nt, Human
uuuaacacagaaaacagggccacu

SEQ ID NO: 1382520 - RNA, 19 nt, Human
uuuuuuuuuuuuuuuuuaa

SEQ ID NO: 1382521 - RNA, 18 nt, Human
aaaaaugugcuauguccc

SEQ ID NO: 1382522 - RNA, 21 nt, Human
aaacagggcccaacccuggug

SEQ ID NO: 1382523 - RNA, 21 nt, Human
aagagcccgcugcccgugcca

SEQ ID NO: 1382524 - RNA, 22 nt, Human
aagcagccucacaaagacagac

SEQ ID NO: 1382525 - RNA, 25 nt, Human
aagcucgcagccaucaguggcuuaa

SEQ ID NO: 1382526 - RNA, 21 nt, Human
aaggagcuugccccaagaggc

SEQ ID NO: 1382527 - RNA, 20 nt, Human
acagacaaaaaugugcuaug

SEQ ID NO: 1382528 - RNA, 18 nt, Human
accaaggugucaugagug

SEQ ID NO: 1382529 - RNA, 21 nt, Human
acccucuccaagacaauguug

SEQ ID NO: 1382530 - RNA, 19 nt, Human
acccuggccucgacaaucu

SEQ ID NO: 1382531 - RNA, 19 nt, Human
accuauuuccauucuccuc

SEQ ID NO: 1382532 - RNA, 18 nt, Human
acuucccugggcuugggc

SEQ ID NO: 1382533 - RNA, 25 nt, Human
agagcaaagaggcucaggaagcagg

SEQ ID NO: 1382534 - RNA, 22 nt, Human
agagguaugagagggugaacca

SEQ ID NO: 1382535 - RNA, 26 nt, Human
agcaaaaaucccuucacuucugugga

SEQ ID NO: 1382536 - RNA, 20 nt, Human
agcuugcaugggcccugcug

SEQ ID NO: 1382537 - RNA, 18 nt, Human
aggaagcaggacuguuuc

SEQ ID NO: 1382538 - RNA, 18 nt, Human
aggaaugcuaggagaugg

SEQ ID NO: 1382539 - RNA, 20 nt, Human
aggaggcagcuguggugaga

SEQ ID NO: 1382540 - RNA, 21 nt, Human
aggcaaggugggaggcagcug

SEQ ID NO: 1382541 - RNA, 22 nt, Human
agggcccaacccugguggccuu

SEQ ID NO: 1382542 - RNA, 18 nt, Human
aggugucaugagugggga

SEQ ID NO: 1382543 - RNA, 23 nt, Human
aguaacaaacaccaaucagcuau

SEQ ID NO: 1382544 - RNA, 21 nt, Human
augcaaccgcaaccaugggcu

SEQ ID NO: 1382545 - RNA, 20 nt, Human
caaagcaagagacaccauuc

SEQ ID NO: 1382546 - RNA, 19 nt, Human
caaagcagccucacaaaga

SEQ ID NO: 1382547 - RNA, 20 nt, Human
caaagcagccucacaaagac

SEQ ID NO: 1382548 - RNA, 23 nt, Human
caaaggaggcagcuguggugaga

SEQ ID NO: 1382549 - RNA, 23 nt, Human
caaggaggaacugaaugggagac

SEQ ID NO: 1382550 - RNA, 24 nt, Human
caaggugggaggcagcuguccccu

SEQ ID NO: 1382551 - RNA, 24 nt, Human
caaguucaagcccuaaccuuaccu

SEQ ID NO: 1382552 - RNA, 24 nt, Human
caccacgcagagcucaagcaggau

SEQ ID NO: 1382553 - RNA, 20 nt, Human
caccaucacccaggcaaggu

SEQ ID NO: 1382554 - RNA, 21 nt, Human
cacccaggcaaggugggaggc

SEQ ID NO: 1382555 - RNA, 23 nt, Human
cacccuguggccaugggcagaau

SEQ ID NO: 1382556 - RNA, 22 nt, Human
cacuggucugacucugcccggc

SEQ ID NO: 1382557 - RNA, 19 nt, Human
cagaaggacagaucuuaau

SEQ ID NO: 1382558 - RNA, 20 nt, Human
cagagcucaagcaggauccu

SEQ ID NO: 1382559 - RNA, 19 nt, Human
cagcagcuucaggugaggc

SEQ ID NO: 1382560 - RNA, 23 nt, Human
cagccucacaaagacagacaaaa

SEQ ID NO: 1382561 - RNA, 20 nt, Human
cagcuaugugaucuugagca

SEQ ID NO: 1382562 - RNA, 26 nt, Human
caggauccuuugccaacuaacggugu

SEQ ID NO: 1382563 - RNA, 19 nt, Human
caugggcccugcugccucu

SEQ ID NO: 1382564 - RNA, 19 nt, Human
cccaggcaaggugggaggc

SEQ ID NO: 1382565 - RNA, 23 nt, Human
ccccaagaggcagagcaaagagg

SEQ ID NO: 1382566 - RNA, 20 nt, Human
ccccagccgacggaaagccc

SEQ ID NO: 1382567 - RNA, 24 nt, Human
cccgugccauugcuugggcaaagu

SEQ ID NO: 1382568 - RNA, 20 nt, Human
cccuaagacuuggcccugcu

SEQ ID NO: 1382569 - RNA, 18 nt, Human
cccucagaaucccucucu

SEQ ID NO: 1382570 - RNA, 21 nt, Human
cccugucuagguuaaggaaug

SEQ ID NO: 1382571 - RNA, 19 nt, Human
cccuguggccaugggcaga

SEQ ID NO: 1382572 - RNA, 20 nt, Human
ccgauggcaguguacuuccc

SEQ ID NO: 1382573 - RNA, 23 nt, Human
ccgauggcaguguacuucccgaa

SEQ ID NO: 1382574 - RNA, 22 nt, Human
ccgcugcccgugccauugcuug

SEQ ID NO: 1382575 - RNA, 21 nt, Human
ccggccucccaggaaccugcu

SEQ ID NO: 1382576 - RNA, 25 nt, Human
ccuaaccuuaccuuaguuuaccagc

SEQ ID NO: 1382577 - RNA, 24 nt, Human
ccuguggccaugggcagaauggac

SEQ ID NO: 1382578 - RNA, 22 nt, Human
cgugccauugcuugggcaaagu

SEQ ID NO: 1382579 - RNA, 23 nt, Human
cucagaaucccucucuucaagcu

SEQ ID NO: 1382580 - RNA, 23 nt, Human
cucccaggaaccugcuggccacu

SEQ ID NO: 1382581 - RNA, 18 nt, Human
cucugucccgcccagccu

SEQ ID NO: 1382582 - RNA, 21 nt, Human
cuggccacugagaagggauuc

SEQ ID NO: 1382583 - RNA, 18 nt, Human
cuguugaacuccagccca

SEQ ID NO: 1382584 - RNA, 20 nt, Human
cuguuugugaugcccuaaga

SEQ ID NO: 1382585 - RNA, 22 nt, Human
cuucccgaacccuggccucgac

SEQ ID NO: 1382586 - RNA, 19 nt, Human
gaacacugacuggacaagg

SEQ ID NO: 1382587 - RNA, 21 nt, Human
gaacccuggccucgacaaucc

SEQ ID NO: 1382588 - RNA, 25 nt, Human
gacacuguuugguggacgcuugugg

SEQ ID NO: 1382589 - RNA, 21 nt, Human
gacuaacccucuccaagacaa

SEQ ID NO: 1382590 - RNA, 20 nt, Human
gagacagaggcauaaaaaua

SEQ ID NO: 1382591 - RNA, 22 nt, Human
gagcaaagaggcucaggaagca

SEQ ID NO: 1382592 - RNA, 24 nt, Human
gagcggugccuugugccggccucc

SEQ ID NO: 1382593 - RNA, 18 nt, Human
gaggaacagcagcuucag

SEQ ID NO: 1382594 - RNA, 22 nt, Human
gagguauucaaggaggaacuga

SEQ ID NO: 1382595 - RNA, 21 nt, Human
gcaugggcccugcugccucuc

SEQ ID NO: 1382596 - RNA, 21 nt, Human
gccacaccgugguucuugacu

SEQ ID NO: 1382597 - RNA, 23 nt, Human
gcccugcugccucucugcacccu

SEQ ID NO: 1382598 - RNA, 18 nt, Human
gccggccucccaggaacc

SEQ ID NO: 1382599 - RNA, 25 nt, Human
gccucucuauuuuuccuuuuuaaaa

SEQ ID NO: 1382600 - RNA, 25 nt, Human
ggaaagaaaggacacuucccugggc

SEQ ID NO: 1382601 - RNA, 20 nt, Human
ggacagccacaaagucuggc

SEQ ID NO: 1382602 - RNA, 25 nt, Human
ggacuaacccucuccaagacaaugu

SEQ ID NO: 1382603 - RNA, 19 nt, Human
gggcuuuuguguguuuggc

SEQ ID NO: 1382604 - RNA, 22 nt, Human
ggguggcagcuugcaugggccc

SEQ ID NO: 1382605 - RNA, 18 nt, Human
ggugccuugugccggccu

SEQ ID NO: 1382606 - RNA, 18 nt, Human
guggccuuucccacuccu

SEQ ID NO: 1382607 - RNA, 20 nt, Human
guggccuuucccacuccucu

SEQ ID NO: 1382608 - RNA, 24 nt, Human
guuaaggaaugcuaggagaugguc

SEQ ID NO: 1382609 - RNA, 19 nt, Human
guucacaguaacaaacacc

SEQ ID NO: 1382610 - RNA, 20 nt, Human
uaaaaucagggcccuccucc

SEQ ID NO: 1382611 - RNA, 20 nt, Human
uacagcacacugaaggcccg

SEQ ID NO: 1382612 - RNA, 18 nt, Human
uaccucuguuucaaagga

SEQ ID NO: 1382613 - RNA, 21 nt, Human
uaggaggaacagcagcuucag

SEQ ID NO: 1382614 - RNA, 24 nt, Human
ucacaguaacaaacaccaagguac

SEQ ID NO: 1382615 - RNA, 23 nt, Human
ucacugaagucuuuacaucuguu

SEQ ID NO: 1382616 - RNA, 20 nt, Human
ucauuguuuugaggccucuc

SEQ ID NO: 1382617 - RNA, 21 nt, Human
ucccacuccuucagcucagau

SEQ ID NO: 1382618 - RNA, 21 nt, Human
ucccagggccuuggucuccuc

SEQ ID NO: 1382619 - RNA, 24 nt, Human
ucccgcccagccuuggugaccaga

SEQ ID NO: 1382620 - RNA, 21 nt, Human
uccucauccacacagagcccu

SEQ ID NO: 1382621 - RNA, 24 nt, Human
uccuccaugcuacuccuuggccac

SEQ ID NO: 1382622 - RNA, 19 nt, Human
ucucccucagaaucccucu

SEQ ID NO: 1382623 - RNA, 21 nt, Human
ucugcaccaaggugucaugag

SEQ ID NO: 1382624 - RNA, 19 nt, Human
ugaaagaacacugacugga

SEQ ID NO: 1382625 - RNA, 21 nt, Human
ugaaagaacacugacuggaca

SEQ ID NO: 1382626 - RNA, 28 nt, Human
ugaccagauggaccaagcucucccucag

SEQ ID NO: 1382627 - RNA, 20 nt, Human
ugaggccucucuauuuuucc

SEQ ID NO: 1382628 - RNA, 18 nt, Human
ugccucccagggccuugg

SEQ ID NO: 1382629 - RNA, 21 nt, Human
uggacgcuuguggcucuccug

SEQ ID NO: 1382630 - RNA, 20 nt, Human
uggaugguucuccuuucucu

SEQ ID NO: 1382631 - RNA, 24 nt, Human
uggcccagaucugcccuuaauugc

SEQ ID NO: 1382632 - RNA, 19 nt, Human
ugggcaggaggucacucug

SEQ ID NO: 1382633 - RNA, 18 nt, Human
ugugggggaugugggaga

SEQ ID NO: 1382634 - RNA, 22 nt, Human
uucuccuuucucucugauccuu

SEQ ID NO: 1382635 - RNA, 22 nt, Human
uugaggccucucuauuuuuccu

SEQ ID NO: 1382636 - RNA, 24 nt, Human
uuggcccugcuccagcacagggcg

SEQ ID NO: 1382637 - RNA, 18 nt, Human
uuuccuuuuuaaaaucag

SEQ ID NO: 1382638 - RNA, 24 nt, Human
uuugguggacgcuuguggcucucc

SEQ ID NO: 1382639 - RNA, 18 nt, Human
agagagaaggcacgaggc

SEQ ID NO: 1382640 - RNA, 23 nt, Human
cacccccaccccagccccaggga

SEQ ID NO: 1382641 - RNA, 19 nt, Human
cagcgacgcccccgcccgc

SEQ ID NO: 1382642 - RNA, 23 nt, Human
caggcuaggccaagagagaaggc

SEQ ID NO: 1382643 - RNA, 22 nt, Human
cagggcagaggccaggccugcc

SEQ ID NO: 1382644 - RNA, 21 nt, Human
ccacccccaccccagccccag

SEQ ID NO: 1382645 - RNA, 21 nt, Human
ccagccccagggagaagaggg

SEQ ID NO: 1382646 - RNA, 18 nt, Human
ccagggagaagagggcgg

SEQ ID NO: 1382647 - RNA, 22 nt, Human
ccaggucccagcucccugccac

SEQ ID NO: 1382648 - RNA, 21 nt, Human
cccagggagaagagggcggau

SEQ ID NO: 1382649 - RNA, 24 nt, Human
cccagggcagaggccaggccugcc

SEQ ID NO: 1382650 - RNA, 21 nt, Human
ccccagggagaagagggcgga

SEQ ID NO: 1382651 - RNA, 18 nt, Human
cccccaccccagccccag

SEQ ID NO: 1382652 - RNA, 19 nt, Human
ccccgcccgccgcccgcga

SEQ ID NO: 1382653 - RNA, 20 nt, Human
cccugggcgccccaguccca

SEQ ID NO: 1382654 - RNA, 22 nt, Human
ccugccacccccaccccagccc

SEQ ID NO: 1382655 - RNA, 26 nt, Human
cgccccagucccagggcagaggcugg

SEQ ID NO: 1382656 - RNA, 24 nt, Human
cgcggccucaccggccagccgcgc

SEQ ID NO: 1382657 - RNA, 18 nt, Human
cuggcagaggcugggcag

SEQ ID NO: 1382658 - RNA, 23 nt, Human
gagaagagggcggaugccagagg

SEQ ID NO: 1382659 - RNA, 18 nt, Human
gagcuggcagaggcuggg

SEQ ID NO: 1382660 - RNA, 22 nt, Human
gccaggccugccuggagaaggc

SEQ ID NO: 1382661 - RNA, 20 nt, Human
ggcagguccugagugggcca

SEQ ID NO: 1382662 - RNA, 24 nt, Human
gggcagaggccaggccugccugga

SEQ ID NO: 1382663 - RNA, 27 nt, Human
gggcagaggccaggccugccuggagaa

SEQ ID NO: 1382664 - RNA, 22 nt, Human
gggcgccccagucccagggcag

SEQ ID NO: 1382665 - RNA, 22 nt, Human
uaggccaagagagaaggcacga

SEQ ID NO: 1382666 - RNA, 19 nt, Human
ucccugccacccccacccc

SEQ ID NO: 1382667 - RNA, 24 nt, Human
ugagugggccaggcuaggccaaga

SEQ ID NO: 1382668 - RNA, 23 nt, Human
ugccuggagaaggcagcacgggg

SEQ ID NO: 1382669 - RNA, 18 nt, Human
uggcagaggcugggcagg

SEQ ID NO: 1382670 - RNA, 21 nt, Human
uuuacaggaguugucucucca

SEQ ID NO: 1382671 - RNA, 18 nt, Human
aaaccgcgucuuuucccc

SEQ ID NO: 1382672 - RNA, 24 nt, Human
acuacacuguggauuccaucagug

SEQ ID NO: 1382673 - RNA, 24 nt, Human
agcagggaagcugauuuaagagaa

SEQ ID NO: 1382674 - RNA, 21 nt, Human
aggccggggccggccggacga

SEQ ID NO: 1382675 - RNA, 22 nt, Human
cacccaguccacuuucaggggc

SEQ ID NO: 1382676 - RNA, 18 nt, Human
ccaguccacuuucagggg

SEQ ID NO: 1382677 - RNA, 21 nt, Human
ccaguccacuuucaggggccc

SEQ ID NO: 1382678 - RNA, 25 nt, Human
cccacucucugccagacagaaucac

SEQ ID NO: 1382679 - RNA, 22 nt, Human
ccugguuuccuugugggaaggg

SEQ ID NO: 1382680 - RNA, 25 nt, Human
cgaggccggggccggccggacgagc

SEQ ID NO: 1382681 - RNA, 19 nt, Human
cggccggacgagcgcagag

SEQ ID NO: 1382682 - RNA, 22 nt, Human
cggccggacgagcgcagagccc

SEQ ID NO: 1382683 - RNA, 21 nt, Human
cucacucgcagucucccuccu

SEQ ID NO: 1382684 - RNA, 25 nt, Human
cucgcagucucccuccugguuuccu

SEQ ID NO: 1382685 - RNA, 21 nt, Human
cugccagacagaaucacccag

SEQ ID NO: 1382686 - RNA, 26 nt, Human
cuggaaaccgcgucuuuuccccacuc

SEQ ID NO: 1382687 - RNA, 19 nt, Human
gacagaaucacccagucca

SEQ ID NO: 1382688 - RNA, 21 nt, Human
gccgggcuggguacugcgcgg

SEQ ID NO: 1382689 - RNA, 18 nt, Human
ggcggggccgggcugggu

SEQ ID NO: 1382690 - RNA, 21 nt, Human
guacugcgcggggcggcgagg

SEQ ID NO: 1382691 - RNA, 19 nt, Human
uacacuguggauuccauca

SEQ ID NO: 1382692 - RNA, 23 nt, Human
uacacuguggauuccaucaggac

SEQ ID NO: 1382693 - RNA, 19 nt, Human
uaugaaaggcugaaaguca

SEQ ID NO: 1382694 - RNA, 23 nt, Human
ucacucgcagucucccuccuggu

SEQ ID NO: 1382695 - RNA, 19 nt, Human
ucugcaagcuggaaaccgc

SEQ ID NO: 1382696 - RNA, 19 nt, Human
ugaugagguggucccgggc

SEQ ID NO: 1382697 - RNA, 19 nt, Human
ugcuuaaacaaguaugaaa

SEQ ID NO: 1382698 - RNA, 23 nt, Human
uggaaaccgcgucuuuuccccac

SEQ ID NO: 1382699 - RNA, 27 nt, Human
uuaaacaaguaugaaaggcugaaaguc

SEQ ID NO: 1382700 - RNA, 18 nt, Human
acaaagaagaggcccaga

SEQ ID NO: 1382701 - RNA, 18 nt, Human
acaaagaagaggcccaga

SEQ ID NO: 1382702 - RNA, 19 nt, Human
acaaagaagaggcccagag

SEQ ID NO: 1382703 - RNA, 25 nt, Human
acagagcuucaggggccucacagag

SEQ ID NO: 1382704 - RNA, 25 nt, Human
acagagcuucaggggccucacagga

SEQ ID NO: 1382705 - RNA, 22 nt, Human
acagggcccuguaugcagggcu

SEQ ID NO: 1382706 - RNA, 22 nt, Human
aggcaguucacaggacagcagg

SEQ ID NO: 1382707 - RNA, 21 nt, Human
aggcaguucacagggcuuugg

SEQ ID NO: 1382708 - RNA, 19 nt, Human
cacaggacugcaggggggc

SEQ ID NO: 1382709 - RNA, 18 nt, Human
cacagggcuuugggggcc

SEQ ID NO: 1382710 - RNA, 21 nt, Human
cagagcuucaggggccucaca

SEQ ID NO: 1382711 - RNA, 21 nt, Human
cagagcuucaggggccucaca

SEQ ID NO: 1382712 - RNA, 21 nt, Human
caggcaguucacaggacagca

SEQ ID NO: 1382713 - RNA, 18 nt, Human
caggcaguucacagggcu

SEQ ID NO: 1382714 - RNA, 18 nt, Human
ccccuaggacuuggcagg

SEQ ID NO: 1382715 - RNA, 24 nt, Human
cccuaggacuuggcaggagccuca

SEQ ID NO: 1382716 - RNA, 19 nt, Human
cggggaagucagggcuucc

SEQ ID NO: 1382717 - RNA, 21 nt, Human
cucacagggcagcaggcaguu

SEQ ID NO: 1382718 - RNA, 22 nt, Human
gacuuggcaggagccucagccu

SEQ ID NO: 1382719 - RNA, 21 nt, Human
gcagcaucagggcucccacac

SEQ ID NO: 1382720 - RNA, 23 nt, Human
gccccggggaagucagggcuucc

SEQ ID NO: 1382721 - RNA, 19 nt, Human
ggccucacagggcagcagg

SEQ ID NO: 1382722 - RNA, 25 nt, Human
gggcagguacagaggccccuaggac

SEQ ID NO: 1382723 - RNA, 24 nt, Human
ucacagggcagcaggcaguucaca

SEQ ID NO: 1382724 - RNA, 19 nt, Human
ucacagggcuuugggggcc

SEQ ID NO: 1382725 - RNA, 19 nt, Human
uggggccccggggaaguca

SEQ ID NO: 1382726 - RNA, 23 nt, Human
ugggggccucacagggcagcagg

SEQ ID NO: 1382727 - RNA, 21 nt, Human
uucacaggacagcaggcaguu

SEQ ID NO: 1382728 - RNA, 24 nt, Human
uucacaggacagcaggcaguucac

SEQ ID NO: 1382729 - RNA, 24 nt, Human
uugggggccucacagggcagcagg

SEQ ID NO: 1382730 - RNA, 20 nt, Human
aaagggcucugggucuaaag

SEQ ID NO: 1382731 - RNA, 23 nt, Human
aacacacccaagaacccacagga

SEQ ID NO: 1382732 - RNA, 22 nt, Human
aacccacugccuagaucuccaa

SEQ ID NO: 1382733 - RNA, 18 nt, Human
aagcaaaugagaccaggc

SEQ ID NO: 1382734 - RNA, 21 nt, Human
acaucucucaugagcaaagcc

SEQ ID NO: 1382735 - RNA, 26 nt, Human
accaaagccacagagaccucaaucug

SEQ ID NO: 1382736 - RNA, 19 nt, Human
accugcauuggguccuuua

SEQ ID NO: 1382737 - RNA, 23 nt, Human
acuacacauauaccccccuuccc

SEQ ID NO: 1382738 - RNA, 18 nt, Human
acuuugggagcauuaugg

SEQ ID NO: 1382739 - RNA, 29 nt, Human
agaagccuuuuuuuuuuuuuuuuuuuuuu

SEQ ID NO: 1382740 - RNA, 19 nt, Human
agacagaaaguaaaaacug

SEQ ID NO: 1382741 - RNA, 23 nt, Human
agacagaaaguaaaaacugguua

SEQ ID NO: 1382742 - RNA, 20 nt, Human
agagcagagcugggacacgg

SEQ ID NO: 1382743 - RNA, 19 nt, Human
agccacagagaccucaauc

SEQ ID NO: 1382744 - RNA, 20 nt, Human
agccuuuuuuuuuuuuuuuu

SEQ ID NO: 1382745 - RNA, 27 nt, Human
aggaaagggucacuuuaggggucuggc

SEQ ID NO: 1382746 - RNA, 25 nt, Human
aggcacagaaggaggcacagaauga

SEQ ID NO: 1382747 - RNA, 19 nt, Human
aggcaguccuagagcagag

SEQ ID NO: 1382748 - RNA, 22 nt, Human
aggcaguccuagagcagagcug

SEQ ID NO: 1382749 - RNA, 21 nt, Human
agggaagcaaaugagaccagg

SEQ ID NO: 1382750 - RNA, 18 nt, Human
aggggccgcagugggagg

SEQ ID NO: 1382751 - RNA, 19 nt, Human
agugccuguuuucaaacgg

SEQ ID NO: 1382752 - RNA, 19 nt, Human
caaagccugaugccuccag

SEQ ID NO: 1382753 - RNA, 24 nt, Human
caaagugccgagcuuggcugcaua

SEQ ID NO: 1382754 - RNA, 21 nt, Human
cacacgaugagccuggcaggg

SEQ ID NO: 1382755 - RNA, 22 nt, Human
cagagcugugcuguugcucucc

SEQ ID NO: 1382756 - RNA, 18 nt, Human
caguccuagagcagagcu

SEQ ID NO: 1382757 - RNA, 21 nt, Human
cauguguauacaguuacaugg

SEQ ID NO: 1382758 - RNA, 19 nt, Human
cccaagaacccacaggaau

SEQ ID NO: 1382759 - RNA, 25 nt, Human
cccaagaacccacaggaauaugucc

SEQ ID NO: 1382760 - RNA, 24 nt, Human
cccacacugaggcacaguuaaagg

SEQ ID NO: 1382761 - RNA, 24 nt, Human
ccccccgagcugaggaggcuucgc

SEQ ID NO: 1382762 - RNA, 19 nt, Human
ccccccuucccuaaaaucu

SEQ ID NO: 1382763 - RNA, 25 nt, Human
cccccuggccuuggagcacuggcuc

SEQ ID NO: 1382764 - RNA, 18 nt, Human
cccucccuccccauaccc

SEQ ID NO: 1382765 - RNA, 20 nt, Human
ccuaacccacacugaggcac

SEQ ID NO: 1382766 - RNA, 20 nt, Human
cuacuacacauauacccccc

SEQ ID NO: 1382767 - RNA, 20 nt, Human
cucacuggguccccggcccc

SEQ ID NO: 1382768 - RNA, 26 nt, Human
cugacaucucucaugagcaaagcccc

SEQ ID NO: 1382769 - RNA, 21 nt, Human
cugaggcacaguuaaagggaa

SEQ ID NO: 1382770 - RNA, 18 nt, Human
gacaccuggucccagguc

SEQ ID NO: 1382771 - RNA, 25 nt, Human
gagcugugcuguugcucuccgggac

SEQ ID NO: 1382772 - RNA, 20 nt, Human
gaggaugggcgccacgggaa

SEQ ID NO: 1382773 - RNA, 24 nt, Human
gaggcaguccuagagcagagcugg

SEQ ID NO: 1382774 - RNA, 19 nt, Human
gcaaacacacccaagaacc

SEQ ID NO: 1382775 - RNA, 21 nt, Human
gcagugggaggcaguccuaga

SEQ ID NO: 1382776 - RNA, 27 nt, Human
gccuuuuuuuuuuuuuuuuuuuuuugg

SEQ ID NO: 1382777 - RNA, 28 nt, Human
gccuuuuuuuuuuuuuuuuuuuuuuggu

SEQ ID NO: 1382778 - RNA, 21 nt, Human
ggaagcaaaugagaccaggcu

SEQ ID NO: 1382779 - RNA, 24 nt, Human
ggcaaacacacccaagaacccaca

SEQ ID NO: 1382780 - RNA, 24 nt, Human
gggccgcagugggaggcaguccua

SEQ ID NO: 1382781 - RNA, 18 nt, Human
gguccuuuaucaucuuaa

SEQ ID NO: 1382782 - RNA, 22 nt, Human
gucaggugaggggccgcagugg

SEQ ID NO: 1382783 - RNA, 21 nt, Human
uaagcagggucaccaaagcca

SEQ ID NO: 1382784 - RNA, 25 nt, Human
uaauacaauaacaaaauuguucccu

SEQ ID NO: 1382785 - RNA, 18 nt, Human
uacaaagugccgagcuug

SEQ ID NO: 1382786 - RNA, 26 nt, Human
uacauggaaccuucaggucagugggg

SEQ ID NO: 1382787 - RNA, 22 nt, Human
uacauguacaucauucuagaca

SEQ ID NO: 1382788 - RNA, 21 nt, Human
uagacagaaaguaaaaacugg

SEQ ID NO: 1382789 - RNA, 22 nt, Human
uagaucuccaacugaagagcuc

SEQ ID NO: 1382790 - RNA, 18 nt, Human
uaggaggcacagaaggag

SEQ ID NO: 1382791 - RNA, 19 nt, Human
uagggcagaagaggaaagg

SEQ ID NO: 1382792 - RNA, 21 nt, Human
ucaaagccugaugccuccagg

SEQ ID NO: 1382793 - RNA, 20 nt, Human
ucaccaaagccacagagacc

SEQ ID NO: 1382794 - RNA, 19 nt, Human
ucccaggucaguuggaccc

SEQ ID NO: 1382795 - RNA, 24 nt, Human
ucccaggucaguuggaccccagca

SEQ ID NO: 1382796 - RNA, 24 nt, Human
ucuaaagaagccuuuuuuuuuuuu

SEQ ID NO: 1382797 - RNA, 23 nt, Human
ucuacauuacgugaguccaaaaa

SEQ ID NO: 1382798 - RNA, 23 nt, Human
ucuccaacugaagagcuccuuuc

SEQ ID NO: 1382799 - RNA, 25 nt, Human
ucucucaugagcaaagcccccuggc

SEQ ID NO: 1382800 - RNA, 21 nt, Human
ucucugcgcgacaccuggucc

SEQ ID NO: 1382801 - RNA, 18 nt, Human
ugagagcgucaggcagag

SEQ ID NO: 1382802 - RNA, 24 nt, Human
ugaggggccgcagugggaggcagu

SEQ ID NO: 1382803 - RNA, 21 nt, Human
ugauguggcaaacacacccaa

SEQ ID NO: 1382804 - RNA, 19 nt, Human
uggcaaacacacccaagaa

SEQ ID NO: 1382805 - RNA, 20 nt, Human
uggcagggaagcaaaugaga

SEQ ID NO: 1382806 - RNA, 23 nt, Human
uggcucccucccuccccauaccc

SEQ ID NO: 1382807 - RNA, 21 nt, Human
uggcuuaacccacugccuaga

SEQ ID NO: 1382808 - RNA, 19 nt, Human
uggguccccggccccccga

SEQ ID NO: 1382809 - RNA, 19 nt, Human
uguccaagcuggcacugca

SEQ ID NO: 1382810 - RNA, 24 nt, Human
ugugcuguugcucuccgggacuug

SEQ ID NO: 1382811 - RNA, 18 nt, Human
uguggcaaacacacccaa

SEQ ID NO: 1382812 - RNA, 21 nt, Human
uguggcaaacacacccaagaa

SEQ ID NO: 1382813 - RNA, 22 nt, Human
uguggcaaacacacccaagaac

SEQ ID NO: 1382814 - RNA, 18 nt, Human
uucauguguauacaguua

SEQ ID NO: 1382815 - RNA, 18 nt, Human
uuuuuuuuuuuuuuuuug

SEQ ID NO: 1382816 - RNA, 20 nt, Human
uuuuuuuuuuuuuuuuuggu

SEQ ID NO: 1382817 - RNA, 22 nt, Human
uuggagccggcgcugagcuggg

SEQ ID NO: 1382818 - RNA, 18 nt, Human
aaaaaacaagauagaggc

SEQ ID NO: 1382819 - RNA, 22 nt, Human
aaaaacaaaaaacaagauagag

SEQ ID NO: 1382820 - RNA, 18 nt, Human
acuaugugccaggcacug

SEQ ID NO: 1382821 - RNA, 25 nt, Human
agaggcagcaaacacaaauucugag

SEQ ID NO: 1382822 - RNA, 22 nt, Human
aggcagcaaacacaaauucuga

SEQ ID NO: 1382823 - RNA, 22 nt, Human
auucugagggagaggaaacggg

SEQ ID NO: 1382824 - RNA, 19 nt, Human
caaaaaacaagauagaggc

SEQ ID NO: 1382825 - RNA, 18 nt, Human
cagaagaaaaaacaaaaa

SEQ ID NO: 1382826 - RNA, 21 nt, Human
cagcgaggugcgaacgcggcg

SEQ ID NO: 1382827 - RNA, 18 nt, Human
ccagaagaaaaaacaaaa

SEQ ID NO: 1382828 - RNA, 19 nt, Human
cccagaagaaaaaacaaaa

SEQ ID NO: 1382829 - RNA, 19 nt, Human
cccuagaugcuggagcagc

SEQ ID NO: 1382830 - RNA, 20 nt, Human
cuaugugccaggcacuguuc

SEQ ID NO: 1382831 - RNA, 18 nt, Human
cugagggagaggaaacgg

SEQ ID NO: 1382832 - RNA, 29 nt, Human
gaagguuggaauaugcccuagaugcuggg

SEQ ID NO: 1382833 - RNA, 22 nt, Human
gagaagccugaggugauggggg

SEQ ID NO: 1382834 - RNA, 23 nt, Human
gagaagccugaggugaugggggc

SEQ ID NO: 1382835 - RNA, 21 nt, Human
gagggagaggaaacgggcagu

SEQ ID NO: 1382836 - RNA, 20 nt, Human
ggcaguugaguaagacggcu

SEQ ID NO: 1382837 - RNA, 22 nt, Human
uccccagaagaaaaaacaaaaa

SEQ ID NO: 1382838 - RNA, 18 nt, Human
ucuagacccuccccagaa

SEQ ID NO: 1382839 - RNA, 23 nt, Human
ucuagacccuccccagaagaaaa

SEQ ID NO: 1382840 - RNA, 21 nt, Human
ugcccuagaugcuggagcagc

SEQ ID NO: 1382841 - RNA, 21 nt, Human
uggaagguuggaauaugcccu

SEQ ID NO: 1382842 - RNA, 22 nt, Human
uggaagguuggaauaugcccua

SEQ ID NO: 1382843 - RNA, 21 nt, Human
uuuaauuuuuuugcucacuuc

SEQ ID NO: 1382844 - RNA, 24 nt, Human
aaagugcagaaauuacgggcauga

SEQ ID NO: 1382845 - RNA, 22 nt, Human
aaauuacgggcaugagccacug

SEQ ID NO: 1382846 - RNA, 22 nt, Human
aaccccuggccucaggcaaucc

SEQ ID NO: 1382847 - RNA, 21 nt, Human
aaggugggagauuccaggccc

SEQ ID NO: 1382848 - RNA, 26 nt, Human
aagugcagaaauuacgggcaugagcc

SEQ ID NO: 1382849 - RNA, 18 nt, Human
aagugcugggauuacagg

SEQ ID NO: 1382850 - RNA, 18 nt, Human
aagugcugggauuacagg

SEQ ID NO: 1382851 - RNA, 19 nt, Human
aagugcugggauuacaggu

SEQ ID NO: 1382852 - RNA, 22 nt, Human
aagugcugggauuacaggugug

SEQ ID NO: 1382853 - RNA, 23 nt, Human
aagugcugggauuacagguguga

SEQ ID NO: 1382854 - RNA, 26 nt, Human
aagugcugggauuacaggugugagcc

SEQ ID NO: 1382855 - RNA, 18 nt, Human
aauuacgggcaugagcca

SEQ ID NO: 1382856 - RNA, 24 nt, Human
aauuacgggcaugagccacugugc

SEQ ID NO: 1382857 - RNA, 19 nt, Human
acaggcaccugccaccacg

SEQ ID NO: 1382858 - RNA, 24 nt, Human
accauguuggccaggcuggucucg

SEQ ID NO: 1382859 - RNA, 21 nt, Human
accccacccccagagccccac

SEQ ID NO: 1382860 - RNA, 22 nt, Human
acuugcucuuaacugcauacgc

SEQ ID NO: 1382861 - RNA, 22 nt, Human
acuugcuuuuuuuuuuuuuuuu

SEQ ID NO: 1382862 - RNA, 24 nt, Human
agaaauuacgggcaugagccacug

SEQ ID NO: 1382863 - RNA, 20 nt, Human
agaauuagaaccccagagga

SEQ ID NO: 1382864 - RNA, 22 nt, Human
agccagaauuagaaccccagag

SEQ ID NO: 1382865 - RNA, 18 nt, Human
aggcaauccuccugccuc

SEQ ID NO: 1382866 - RNA, 18 nt, Human
aggcacucggcaccacgg

SEQ ID NO: 1382867 - RNA, 25 nt, Human
aggcuggagugcaguggcgugaucu

SEQ ID NO: 1382868 - RNA, 22 nt, Human
aggcuggucucaaaccccuggc

SEQ ID NO: 1382869 - RNA, 27 nt, Human
agguacuugcuuuuuuuuuuuuuuuuu

SEQ ID NO: 1382870 - RNA, 21 nt, Human
aguagcugggauuacaggcac

SEQ ID NO: 1382871 - RNA, 23 nt, Human
agugcaguggcgugaucuuggcu

SEQ ID NO: 1382872 - RNA, 24 nt, Human
agugcaguggcgugaucuuggcuc

SEQ ID NO: 1382873 - RNA, 20 nt, Human
agugcugggauuacaggugu

SEQ ID NO: 1382874 - RNA, 21 nt, Human
auccuccugccucagccuccc

SEQ ID NO: 1382875 - RNA, 24 nt, Human
auggggucucgcuauguugcucag

SEQ ID NO: 1382876 - RNA, 18 nt, Human
augggguuucaccauguu

SEQ ID NO: 1382877 - RNA, 22 nt, Human
augggguuucaccauguuggcc

SEQ ID NO: 1382878 - RNA, 23 nt, Human
augggguuucaccauguuggcca

SEQ ID NO: 1382879 - RNA, 24 nt, Human
augggguuucaccauguuggccag

SEQ ID NO: 1382880 - RNA, 20 nt, Human
auguugcucaggcuggucuc

SEQ ID NO: 1382881 - RNA, 22 nt, Human
auucuguggcccaggcuggagu

SEQ ID NO: 1382882 - RNA, 24 nt, Human
caaaccccuggccucaggcaaucc

SEQ ID NO: 1382883 - RNA, 24 nt, Human
caaagugcagaaauuacgggcaug

SEQ ID NO: 1382884 - RNA, 22 nt, Human
caagcaauucuccugccucagc

SEQ ID NO: 1382885 - RNA, 19 nt, Human
caagugauccacccaccuc

SEQ ID NO: 1382886 - RNA, 24 nt, Human
caagugcugggauuacagguguga

SEQ ID NO: 1382887 - RNA, 23 nt, Human
cacacuaaacauuguccauauug

SEQ ID NO: 1382888 - RNA, 21 nt, Human
caccauguuggccaggcuggu

SEQ ID NO: 1382889 - RNA, 24 nt, Human
caccauguuggccaggcuggucuc

SEQ ID NO: 1382890 - RNA, 27 nt, Human
caccauguuggccaggcuggucucgaa

SEQ ID NO: 1382891 - RNA, 22 nt, Human
cacccaccucagucucccaaag

SEQ ID NO: 1382892 - RNA, 23 nt, Human
cacccaccucagucucccaaagu

SEQ ID NO: 1382893 - RNA, 20 nt, Human
caccccacccccagagcccc

SEQ ID NO: 1382894 - RNA, 19 nt, Human
cacuggggugaaggaggag

SEQ ID NO: 1382895 - RNA, 19 nt, Human
cacugugcccggccaaggc

SEQ ID NO: 1382896 - RNA, 22 nt, Human
cagcauuuuccaccccaccccc

SEQ ID NO: 1382897 - RNA, 20 nt, Human
cagccuccugaguagcuggg

SEQ ID NO: 1382898 - RNA, 22 nt, Human
caggcaauccuccugccucagc

SEQ ID NO: 1382899 - RNA, 21 nt, Human
caggcaccugccaccacgccc

SEQ ID NO: 1382900 - RNA, 18 nt, Human
caucaagaacacaucugu

SEQ ID NO: 1382901 - RNA, 24 nt, Human
cauguuggccaggcuggucucgaa

SEQ ID NO: 1382902 - RNA, 24 nt, Human
cauucuguggcccaggcuggagug

SEQ ID NO: 1382903 - RNA, 24 nt, Human
ccaaagugcagaaauuacgggcau

SEQ ID NO: 1382904 - RNA, 19 nt, Human
ccaagugcugggauuacag

SEQ ID NO: 1382905 - RNA, 20 nt, Human
ccaagugcugggauuacagg

SEQ ID NO: 1382906 - RNA, 20 nt, Human
ccaagugcugggauuacagg

SEQ ID NO: 1382907 - RNA, 20 nt, Human
ccaccacgcccggcuaauuu

SEQ ID NO: 1382908 - RNA, 22 nt, Human
cccaagugcugggauuacaggu

SEQ ID NO: 1382909 - RNA, 24 nt, Human
cccaagugcugggauuacaggugu

SEQ ID NO: 1382910 - RNA, 22 nt, Human
ccccaagugcugggauuacagg

SEQ ID NO: 1382911 - RNA, 20 nt, Human
ccccagaggaucaagguggg

SEQ ID NO: 1382912 - RNA, 21 nt, Human
cccccaucaagaacacaucug

SEQ ID NO: 1382913 - RNA, 22 nt, Human
ccccugagccagaauuagaacc

SEQ ID NO: 1382914 - RNA, 18 nt, Human
cccggccaaggcacuugc

SEQ ID NO: 1382915 - RNA, 18 nt, Human
cccuggagguucaaggcg

SEQ ID NO: 1382916 - RNA, 20 nt, Human
ccgcccucuuucugccagau

SEQ ID NO: 1382917 - RNA, 27 nt, Human
ccgccuccuggguucaagcaauucuuu

SEQ ID NO: 1382918 - RNA, 19 nt, Human
ccuccgccuccuggguuca

SEQ ID NO: 1382919 - RNA, 25 nt, Human
ccuccugccucagccuccccaagug

SEQ ID NO: 1382920 - RNA, 24 nt, Human
ccuccuggguucaagcaauucucc

SEQ ID NO: 1382921 - RNA, 24 nt, Human
ccugacgucaagugauccacccac

SEQ ID NO: 1382922 - RNA, 23 nt, Human
ccugaguagcugggauuacaggc

SEQ ID NO: 1382923 - RNA, 24 nt, Human
ccugaguagcugggauuacaggca

SEQ ID NO: 1382924 - RNA, 24 nt, Human
ccugccucagccuccccaagugcu

SEQ ID NO: 1382925 - RNA, 23 nt, Human
ccugccucagccuccugaguagc

SEQ ID NO: 1382926 - RNA, 18 nt, Human
ccuggccucaggcaaucc

SEQ ID NO: 1382927 - RNA, 23 nt, Human
ccuggguucaagcaauucuccug

SEQ ID NO: 1382928 - RNA, 18 nt, Human
cgcccucuuucugccaga

SEQ ID NO: 1382929 - RNA, 18 nt, Human
cggcaaccuccgccuccu

SEQ ID NO: 1382930 - RNA, 24 nt, Human
cggcaaccuccgccuccuggguuc

SEQ ID NO: 1382931 - RNA, 22 nt, Human
cggcccaaggcagcaggcacuc

SEQ ID NO: 1382932 - RNA, 22 nt, Human
cgucaagugauccacccaccuc

SEQ ID NO: 1382933 - RNA, 20 nt, Human
cuaucccccaucaagaacac

SEQ ID NO: 1382934 - RNA, 19 nt, Human
cucaaaccccuggccucag

SEQ ID NO: 1382935 - RNA, 24 nt, Human
cucagccuccugaguagcugggau

SEQ ID NO: 1382936 - RNA, 21 nt, Human
cuccuggguucaagcaauucu

SEQ ID NO: 1382937 - RNA, 26 nt, Human
cucuuaacugcauacgcgcaugcaca

SEQ ID NO: 1382938 - RNA, 23 nt, Human
cugaguagcugggauuacaggca

SEQ ID NO: 1382939 - RNA, 23 nt, Human
cugccucagccuccugaguagcu

SEQ ID NO: 1382940 - RNA, 22 nt, Human
cuggaaacccuggagguucaag

SEQ ID NO: 1382941 - RNA, 21 nt, Human
gaaauuacgggcaugagccac

SEQ ID NO: 1382942 - RNA, 23 nt, Human
gaaauuacgggcaugagccacug

SEQ ID NO: 1382943 - RNA, 24 nt, Human
gacgucaagugauccacccaccuc

SEQ ID NO: 1382944 - RNA, 18 nt, Human
gagaugggguuucaccau

SEQ ID NO: 1382945 - RNA, 24 nt, Human
gagaugggguuucaccauguuggc

SEQ ID NO: 1382946 - RNA, 25 nt, Human
gaguagcugggauuacaggcaccug

SEQ ID NO: 1382947 - RNA, 18 nt, Human
gauuacaggugugagcca

SEQ ID NO: 1382948 - RNA, 21 nt, Human
gauuacaggugugagccacca

SEQ ID NO: 1382949 - RNA, 22 nt, Human
gauuacaggugugagccaccac

SEQ ID NO: 1382950 - RNA, 23 nt, Human
gcaauccuccugccucagccucc

SEQ ID NO: 1382951 - RNA, 26 nt, Human
gcaauccuccugccucagccucccca

SEQ ID NO: 1382952 - RNA, 21 nt, Human
gccaauuuuagcuucagcugg

SEQ ID NO: 1382953 - RNA, 20 nt, Human
gcccaggcuggagugcagug

SEQ ID NO: 1382954 - RNA, 24 nt, Human
gcccaggcuggagugcaguggcgu

SEQ ID NO: 1382955 - RNA, 23 nt, Human
gcccggcuaauuuuuuguauuuu

SEQ ID NO: 1382956 - RNA, 19 nt, Human
gcuggagugcaguggcgug

SEQ ID NO: 1382957 - RNA, 23 nt, Human
gcuggucucaaaccccuggccuc

SEQ ID NO: 1382958 - RNA, 22 nt, Human
ggcaugagccacugugcccggc

SEQ ID NO: 1382959 - RNA, 24 nt, Human
ggcccaggcuggagugcaguggcg

SEQ ID NO: 1382960 - RNA, 22 nt, Human
ggcuggagugcaguggcgugau

SEQ ID NO: 1382961 - RNA, 19 nt, Human
gggagaggagguguggggc

SEQ ID NO: 1382962 - RNA, 19 nt, Human
gggagaggagguguggggc

SEQ ID NO: 1382963 - RNA, 22 nt, Human
gggguuucaccauguuggccag

SEQ ID NO: 1382964 - RNA, 22 nt, Human
gggucucgcuauguugcucagg

SEQ ID NO: 1382965 - RNA, 22 nt, Human
ggguuucaccauguuggccagg

SEQ ID NO: 1382966 - RNA, 23 nt, Human
guagagaugggguuucaccaugu

SEQ ID NO: 1382967 - RNA, 18 nt, Human
guagcugggauuacaggc

SEQ ID NO: 1382968 - RNA, 24 nt, Human
gugauccacccaccucagucuccc

SEQ ID NO: 1382969 - RNA, 19 nt, Human
guggcccaggcuggagugc

SEQ ID NO: 1382970 - RNA, 22 nt, Human
uaaagauggggucucgcuaugu

SEQ ID NO: 1382971 - RNA, 24 nt, Human
uaauuuuuuguauuuuuaguagag

SEQ ID NO: 1382972 - RNA, 23 nt, Human
uacaggcaccugccaccacgccc

SEQ ID NO: 1382973 - RNA, 22 nt, Human
uacaggugugagccaccacacu

SEQ ID NO: 1382974 - RNA, 24 nt, Human
uacaggugugagccaccacacuca

SEQ ID NO: 1382975 - RNA, 24 nt, Human
uacgggcaugagccacugugcccg

SEQ ID NO: 1382976 - RNA, 22 nt, Human
uagagaugggguuucaccaugu

SEQ ID NO: 1382977 - RNA, 30 nt, Human
uagcuccaggugguaaaaguccuggcccca

SEQ ID NO: 1382978 - RNA, 24 nt, Human
uaguagagaugggguuucaccaug

SEQ ID NO: 1382979 - RNA, 26 nt, Human
uaguagagaugggguuucaccauguu

SEQ ID NO: 1382980 - RNA, 23 nt, Human
uauguugcucaggcuggucucaa

SEQ ID NO: 1382981 - RNA, 24 nt, Human
uauguugcucaggcuggucucaaa

SEQ ID NO: 1382982 - RNA, 19 nt, Human
ucaagcaauucuccugccu

SEQ ID NO: 1382983 - RNA, 24 nt, Human
ucacggcaaccuccgccuccuggg

SEQ ID NO: 1382984 - RNA, 25 nt, Human
ucacggcaaccuccgccuccugggu

SEQ ID NO: 1382985 - RNA, 27 nt, Human
ucacggcaaccuccgccuccuggguuc

SEQ ID NO: 1382986 - RNA, 20 nt, Human
ucagccuccugaguagcugg

SEQ ID NO: 1382987 - RNA, 21 nt, Human
uccacccaccucagucuccca

SEQ ID NO: 1382988 - RNA, 24 nt, Human
uccaccccacccccagagccccac

SEQ ID NO: 1382989 - RNA, 24 nt, Human
ucccaaagugcagaaauuacgggc

SEQ ID NO: 1382990 - RNA, 23 nt, Human
uccccaagugcugggauuacagg

SEQ ID NO: 1382991 - RNA, 24 nt, Human
uccgccuccuggguucaagcaauu

SEQ ID NO: 1382992 - RNA, 24 nt, Human
uccugaguagcugggauuacaggc

SEQ ID NO: 1382993 - RNA, 21 nt, Human
uccuggguucaagcaauucuc

SEQ ID NO: 1382994 - RNA, 24 nt, Human
uccuggguucaagcaauucuccug

SEQ ID NO: 1382995 - RNA, 18 nt, Human
ucgugagauggagucuca

SEQ ID NO: 1382996 - RNA, 23 nt, Human
ucucauucuguggcccaggcugg

SEQ ID NO: 1382997 - RNA, 24 nt, Human
ucucauucuguggcccaggcugga

SEQ ID NO: 1382998 - RNA, 20 nt, Human
ucucccaaagugcagaaauu

SEQ ID NO: 1382999 - RNA, 24 nt, Human
ucuccugccucagccuccugagua

SEQ ID NO: 1383000 - RNA, 21 nt, Human
ucucgaacuccugacgucaag

SEQ ID NO: 1383001 - RNA, 18 nt, Human
ucucgcuauguugcucag

SEQ ID NO: 1383002 - RNA, 19 nt, Human
ucucgcuauguugcucagg

SEQ ID NO: 1383003 - RNA, 23 nt, Human
ucucgcuauguugcucaggcugg

SEQ ID NO: 1383004 - RNA, 24 nt, Human
ucucgcuauguugcucaggcuggu

SEQ ID NO: 1383005 - RNA, 18 nt, Human
ucuguggcccaggcugga

SEQ ID NO: 1383006 - RNA, 23 nt, Human
ugacuggacaugagccuggcaug

SEQ ID NO: 1383007 - RNA, 21 nt, Human
ugagccagaauuagaacccca

SEQ ID NO: 1383008 - RNA, 24 nt, Human
ugauccacccaccucagucuccca

SEQ ID NO: 1383009 - RNA, 24 nt, Human
ugccucagccuccccaagugcugg

SEQ ID NO: 1383010 - RNA, 24 nt, Human
ugccucagccuccugaguagcugg

SEQ ID NO: 1383011 - RNA, 26 nt, Human
ugcucuuaacugcauacgcgcaugca

SEQ ID NO: 1383012 - RNA, 24 nt, Human
ugcugggauuacaggugugagcca

SEQ ID NO: 1383013 - RNA, 19 nt, Human
uggagugcaguggcgugau

SEQ ID NO: 1383014 - RNA, 23 nt, Human
uggagugcaguggcgugaucuug

SEQ ID NO: 1383015 - RNA, 24 nt, Human
uggagugcaguggcgugaucuugg

SEQ ID NO: 1383016 - RNA, 24 nt, Human
uggccaggcuggucucgaacuccu

SEQ ID NO: 1383017 - RNA, 18 nt, Human
uggcccaggcuggagugc

SEQ ID NO: 1383018 - RNA, 20 nt, Human
uggccucaggcaauccuccu

SEQ ID NO: 1383019 - RNA, 24 nt, Human
uggccucaggcaauccuccugccu

SEQ ID NO: 1383020 - RNA, 19 nt, Human
ugggagauuccaggccccg

SEQ ID NO: 1383021 - RNA, 21 nt, Human
ugggauuacaggcaccugcca

SEQ ID NO: 1383022 - RNA, 22 nt, Human
ugggauuacaggcaccugccac

SEQ ID NO: 1383023 - RNA, 24 nt, Human
ugggauuacaggcaccugccacca

SEQ ID NO: 1383024 - RNA, 18 nt, Human
ugggauuacaggugugag

SEQ ID NO: 1383025 - RNA, 19 nt, Human
ugggauuacaggugugagc

SEQ ID NO: 1383026 - RNA, 22 nt, Human
ugggauuacaggugugagccac

SEQ ID NO: 1383027 - RNA, 23 nt, Human
ugggauuacaggugugagccacc

SEQ ID NO: 1383028 - RNA, 24 nt, Human
ugggauuacaggugugagccacca

SEQ ID NO: 1383029 - RNA, 24 nt, Human
uggggucucgcuauguugcucagg

SEQ ID NO: 1383030 - RNA, 18 nt, Human
uggggugaaggaggagga

SEQ ID NO: 1383031 - RNA, 24 nt, Human
ugggguuucaccauguuggccagg

SEQ ID NO: 1383032 - RNA, 21 nt, Human
uggguucaagcaauucuccug

SEQ ID NO: 1383033 - RNA, 23 nt, Human
uggguucaagcaauucuccugcc

SEQ ID NO: 1383034 - RNA, 24 nt, Human
uggguucaagcaauucuccugccu

SEQ ID NO: 1383035 - RNA, 21 nt, Human
uguauuuuuaguagagauggg

SEQ ID NO: 1383036 - RNA, 21 nt, Human
uguggcccaggcuggagugca

SEQ ID NO: 1383037 - RNA, 20 nt, Human
uguugcucaggcuggucuca

SEQ ID NO: 1383038 - RNA, 18 nt, Human
uuaguagagaugggguuu

SEQ ID NO: 1383039 - RNA, 22 nt, Human
uuaguagagaugggguuucacc

SEQ ID NO: 1383040 - RNA, 24 nt, Human
uuaguagagaugggguuucaccau

SEQ ID NO: 1383041 - RNA, 21 nt, Human
uucaagcaauucuccugccuc

SEQ ID NO: 1383042 - RNA, 24 nt, Human
uucaagcaauucuccugccucagc

SEQ ID NO: 1383043 - RNA, 18 nt, Human
uucuguggcccaggcugg

SEQ ID NO: 1383044 - RNA, 24 nt, Human
uuucaccauguuggccaggcuggu

SEQ ID NO: 1383045 - RNA, 24 nt, Human
uuuuuaguagagaugggguuucac

SEQ ID NO: 1383046 - RNA, 21 nt, Human
uuuuuguauuuuuaguagaga

SEQ ID NO: 1383047 - RNA, 24 nt, Human
uuuuuuguauuuuuaguagagaug

SEQ ID NO: 1383048 - RNA, 18 nt, Human
uuuuuuuuuuuuuuuucg

SEQ ID NO: 1383049 - RNA, 20 nt, Human
uuuuuuuuuuuuuuuuucgu

SEQ ID NO: 1383050 - RNA, 21 nt, Human
acuuuggcuuccagaaaagag

SEQ ID NO: 1383051 - RNA, 21 nt, Human
agagggaagguggggaccuag

SEQ ID NO: 1383052 - RNA, 19 nt, Human
caccugagucccccaggac

SEQ ID NO: 1383053 - RNA, 24 nt, Human
cccaggaccagggcaucccaaggc

SEQ ID NO: 1383054 - RNA, 19 nt, Human
cccugaacccgggguuccc

SEQ ID NO: 1383055 - RNA, 21 nt, Human
ccuggcccugaacccgggguu

SEQ ID NO: 1383056 - RNA, 24 nt, Human
cuaguaacaauaaccauuuauucc

SEQ ID NO: 1383057 - RNA, 19 nt, Human
gaccuaguaacaauaacca

SEQ ID NO: 1383058 - RNA, 22 nt, Human
gcaccugagucccccaggacca

SEQ ID NO: 1383059 - RNA, 21 nt, Human
gcccugaacccgggguuccca

SEQ ID NO: 1383060 - RNA, 20 nt, Human
gggaagguggggaccuagua

SEQ ID NO: 1383061 - RNA, 18 nt, Human
ugagucccccaggaccag

SEQ ID NO: 1383062 - RNA, 20 nt, Human
ugagucccccaggaccaggg

SEQ ID NO: 1383063 - RNA, 25 nt, Human
uggcccugaacccgggguucccucc

SEQ ID NO: 1383064 - RNA, 23 nt, Human
uggggaggcugacuuuggcuucc

SEQ ID NO: 1383065 - RNA, 19 nt, Human
uuuuuuuuuuuaggcagug

SEQ ID NO: 1383066 - RNA, 23 nt, Human
uuuuuuuuuuuuuuuuuuuuagg

SEQ ID NO: 1383067 - RNA, 21 nt, Human
aacuguccggccccgagucac

SEQ ID NO: 1383068 - RNA, 23 nt, Human
accaagggcgggcagcacccucc

SEQ ID NO: 1383069 - RNA, 24 nt, Human
acugggcauuuugcuucuugucau

SEQ ID NO: 1383070 - RNA, 22 nt, Human
caaaggcuuggcucccgaaugu

SEQ ID NO: 1383071 - RNA, 21 nt, Human
caagggcgggcagcacccucc

SEQ ID NO: 1383072 - RNA, 20 nt, Human
cacagauauaguuccgcacc

SEQ ID NO: 1383073 - RNA, 19 nt, Human
cacuggucacaggcaaagu

SEQ ID NO: 1383074 - RNA, 28 nt, Human
cagagacuuuccuuucuggguaaggcuc

SEQ ID NO: 1383075 - RNA, 19 nt, Human
cagcacccuccgacccucc

SEQ ID NO: 1383076 - RNA, 18 nt, Human
cagcccugguaaggacac

SEQ ID NO: 1383077 - RNA, 21 nt, Human
caggcaaaguccagcucaguc

SEQ ID NO: 1383078 - RNA, 20 nt, Human
cauuuugcuucuugucauuu

SEQ ID NO: 1383079 - RNA, 22 nt, Human
ccagcagaaucccgcgggugcu

SEQ ID NO: 1383080 - RNA, 21 nt, Human
cccgagguuccuagaggaccc

SEQ ID NO: 1383081 - RNA, 18 nt, Human
cccugggaggggguccug

SEQ ID NO: 1383082 - RNA, 23 nt, Human
ccucacaccugggggacagaggc

SEQ ID NO: 1383083 - RNA, 21 nt, Human
ccugcacuggaacccacagac

SEQ ID NO: 1383084 - RNA, 24 nt, Human
cgggugcaccauggacauguguac

SEQ ID NO: 1383085 - RNA, 22 nt, Human
cgugcagcccugguaaggacac

SEQ ID NO: 1383086 - RNA, 18 nt, Human
cucacacuuacugcaaag

SEQ ID NO: 1383087 - RNA, 23 nt, Human
cucgguggcccagguggugguuc

SEQ ID NO: 1383088 - RNA, 18 nt, Human
cucuguguggaugagcuu

SEQ ID NO: 1383089 - RNA, 21 nt, Human
cucuguguggaugagcuucac

SEQ ID NO: 1383090 - RNA, 23 nt, Human
cuggaacccacagaccucacacc

SEQ ID NO: 1383091 - RNA, 23 nt, Human
cuggaacccacagaccucacacc

SEQ ID NO: 1383092 - RNA, 20 nt, Human
cuucaccgccuggcccucug

SEQ ID NO: 1383093 - RNA, 22 nt, Human
cuuccauccgggcuuggguccc

SEQ ID NO: 1383094 - RNA, 21 nt, Human
gacacuuguagauggugggaa

SEQ ID NO: 1383095 - RNA, 19 nt, Human
gcagcggaggacgccagca

SEQ ID NO: 1383096 - RNA, 21 nt, Human
gccuccagcaccaagggcggg

SEQ ID NO: 1383097 - RNA, 20 nt, Human
gcgggugcacacgaagggug

SEQ ID NO: 1383098 - RNA, 24 nt, Human
gcucgguggcccagguggugguuc

SEQ ID NO: 1383099 - RNA, 19 nt, Human
ggaugagcuucacguggcg

SEQ ID NO: 1383100 - RNA, 24 nt, Human
ggcgggcagcacccuccgacccuc

SEQ ID NO: 1383101 - RNA, 20 nt, Human
gggacagaggcagauaagaa

SEQ ID NO: 1383102 - RNA, 20 nt, Human
ggucacaggcaaaguccagc

SEQ ID NO: 1383103 - RNA, 21 nt, Human
ggugcgagggccacagcccug

SEQ ID NO: 1383104 - RNA, 18 nt, Human
ggugguuccgccuccagg

SEQ ID NO: 1383105 - RNA, 21 nt, Human
guagcggucgaucaugaaaac

SEQ ID NO: 1383106 - RNA, 21 nt, Human
guccaggcugcuagaggugcu

SEQ ID NO: 1383107 - RNA, 20 nt, Human
guccugacucacacuuacug

SEQ ID NO: 1383108 - RNA, 22 nt, Human
uaaaccacuggucccagagcag

SEQ ID NO: 1383109 - RNA, 23 nt, Human
uacauugagguugugggccuucu

SEQ ID NO: 1383110 - RNA, 19 nt, Human
ucacugccguccucaggug

SEQ ID NO: 1383111 - RNA, 19 nt, Human
uccagcaccaagggcgggc

SEQ ID NO: 1383112 - RNA, 18 nt, Human
ucccagagcagaggaagg

SEQ ID NO: 1383113 - RNA, 20 nt, Human
ucccagagcagaggaaggcu

SEQ ID NO: 1383114 - RNA, 24 nt, Human
uccucagguggguucgggcuucac

SEQ ID NO: 1383115 - RNA, 18 nt, Human
uccucguggugcuccuug

SEQ ID NO: 1383116 - RNA, 24 nt, Human
uccugggucugugucagcgggugc

SEQ ID NO: 1383117 - RNA, 18 nt, Human
ucucacaacgaagcuucu

SEQ ID NO: 1383118 - RNA, 18 nt, Human
ucuguggucacagagggg

SEQ ID NO: 1383119 - RNA, 18 nt, Human
ugaaaaccuuguugcagc

SEQ ID NO: 1383120 - RNA, 22 nt, Human
ugacacagccacugcggagucc

SEQ ID NO: 1383121 - RNA, 18 nt, Human
ugagccggacaccaagcc

SEQ ID NO: 1383122 - RNA, 22 nt, Human
ugagccggacaccaagcccgcc

SEQ ID NO: 1383123 - RNA, 24 nt, Human
ugaggcugacacagccacugcgga

SEQ ID NO: 1383124 - RNA, 25 nt, Human
ugaugugcuucuucauggcguagcg

SEQ ID NO: 1383125 - RNA, 19 nt, Human
ugcacacgaagggugaggc

SEQ ID NO: 1383126 - RNA, 23 nt, Human
ugcacacgaagggugaggcugac

SEQ ID NO: 1383127 - RNA, 21 nt, Human
uggaacccacagaccucacac

SEQ ID NO: 1383128 - RNA, 22 nt, Human
uggcccagguggugguuccgcc

SEQ ID NO: 1383129 - RNA, 23 nt, Human
uggcccagguggugguuccgccu

SEQ ID NO: 1383130 - RNA, 23 nt, Human
uggucacaggcaaaguccagcuc

SEQ ID NO: 1383131 - RNA, 20 nt, Human
uguccugggucugugucagc

SEQ ID NO: 1383132 - RNA, 20 nt, Human
uguugcagccaggguggggg

SEQ ID NO: 1383133 - RNA, 23 nt, Human
uugagguugugggccuucucaaa

SEQ ID NO: 1383134 - RNA, 20 nt, Human
aaggagacccccagggccuu

SEQ ID NO: 1383135 - RNA, 20 nt, Human
acccaccccgcugcacgcgc

SEQ ID NO: 1383136 - RNA, 24 nt, Human
acuccgaaguguacuccagagagg

SEQ ID NO: 1383137 - RNA, 23 nt, Human
acuugcuggggggcugcgugggg

SEQ ID NO: 1383138 - RNA, 18 nt, Human
agacccccagggccuugc

SEQ ID NO: 1383139 - RNA, 20 nt, Human
agaggucccggaauggcagg

SEQ ID NO: 1383140 - RNA, 22 nt, Human
agcuggcccugggauccagagc

SEQ ID NO: 1383141 - RNA, 23 nt, Human
aggagguccuugugaggcucagg

SEQ ID NO: 1383142 - RNA, 18 nt, Human
aggccugggagccuggcg

SEQ ID NO: 1383143 - RNA, 22 nt, Human
aggcuguuucgacgauuccuuc

SEQ ID NO: 1383144 - RNA, 18 nt, Human
agggacuggcaggggcug

SEQ ID NO: 1383145 - RNA, 20 nt, Human
agggacuggcaggggcugcu

SEQ ID NO: 1383146 - RNA, 19 nt, Human
caccccgcugcacgcgcac

SEQ ID NO: 1383147 - RNA, 23 nt, Human
cacgcgcaccgcuuucccgcagc

SEQ ID NO: 1383148 - RNA, 18 nt, Human
cacugaggcgcugcuggc

SEQ ID NO: 1383149 - RNA, 18 nt, Human
cagagggcagcuggcccu

SEQ ID NO: 1383150 - RNA, 22 nt, Human
cagcugcaggugaucucggugg

SEQ ID NO: 1383151 - RNA, 21 nt, Human
caggagguccuugugaggcuc

SEQ ID NO: 1383152 - RNA, 22 nt, Human
caggccagguguuucaggcacc

SEQ ID NO: 1383153 - RNA, 18 nt, Human
cagggcacccaccccgcu

SEQ ID NO: 1383154 - RNA, 23 nt, Human
ccaccccgcugcacgcgcaccgc

SEQ ID NO: 1383155 - RNA, 25 nt, Human
ccccuccucaccagccaggaggucc

SEQ ID NO: 1383156 - RNA, 20 nt, Human
cccugggauccagagcuggg

SEQ ID NO: 1383157 - RNA, 21 nt, Human
cccugugcccgacgcuggccc

SEQ ID NO: 1383158 - RNA, 22 nt, Human
ccgagaccagugggagcugccc

SEQ ID NO: 1383159 - RNA, 21 nt, Human
ccuugccuggacccgagggac

SEQ ID NO: 1383160 - RNA, 20 nt, Human
cgagaccagugggagcugcc

SEQ ID NO: 1383161 - RNA, 21 nt, Human
cgcaccgcuuucccgcagccu

SEQ ID NO: 1383162 - RNA, 18 nt, Human
cgcccgggguuggcugcu

SEQ ID NO: 1383163 - RNA, 19 nt, Human
cgggcacugaggcgcugcu

SEQ ID NO: 1383164 - RNA, 19 nt, Human
cuccucaccagccaggagg

SEQ ID NO: 1383165 - RNA, 23 nt, Human
cugaagacucuguggaggccugg

SEQ ID NO: 1383166 - RNA, 23 nt, Human
cuggcccugggcccugccggaca

SEQ ID NO: 1383167 - RNA, 18 nt, Human
gaccagugggagcugccc

SEQ ID NO: 1383168 - RNA, 20 nt, Human
gaccgggcuggaggugacgu

SEQ ID NO: 1383169 - RNA, 21 nt, Human
gacucuguggaggccugggag

SEQ ID NO: 1383170 - RNA, 18 nt, Human
gacuggcaggggcugcug

SEQ ID NO: 1383171 - RNA, 22 nt, Human
gagcugcccugugcccgacgcu

SEQ ID NO: 1383172 - RNA, 24 nt, Human
gaggugacguuggguggcugcagg

SEQ ID NO: 1383173 - RNA, 21 nt, Human
gauccagagcuggggguggcc

SEQ ID NO: 1383174 - RNA, 20 nt, Human
gcaccgcuuucccgcagccu

SEQ ID NO: 1383175 - RNA, 22 nt, Human
gcacgcgcaccgcuuucccgca

SEQ ID NO: 1383176 - RNA, 19 nt, Human
gcauuuaaggagaccccca

SEQ ID NO: 1383177 - RNA, 21 nt, Human
gcccugggauccagagcuggg

SEQ ID NO: 1383178 - RNA, 24 nt, Human
gcggcuggguguguugccgagacc

SEQ ID NO: 1383179 - RNA, 19 nt, Human
ggacccgagggacuggcag

SEQ ID NO: 1383180 - RNA, 24 nt, Human
ggacgggagggcugacugggaggg

SEQ ID NO: 1383181 - RNA, 20 nt, Human
ggccagguguuucaggcacc

SEQ ID NO: 1383182 - RNA, 18 nt, Human
ggcccugggauccagagc

SEQ ID NO: 1383183 - RNA, 19 nt, Human
ggcuggaggugacguuggg

SEQ ID NO: 1383184 - RNA, 25 nt, Human
gggauguugcugcugcugggagacu

SEQ ID NO: 1383185 - RNA, 19 nt, Human
gggggcugcguccuccggc

SEQ ID NO: 1383186 - RNA, 21 nt, Human
guacuccagagaggucccgga

SEQ ID NO: 1383187 - RNA, 23 nt, Human
guguggccagcugcaggugaucu

SEQ ID NO: 1383188 - RNA, 24 nt, Human
uccagagcuggggguggccgagga

SEQ ID NO: 1383189 - RNA, 18 nt, Human
uccggguuagcuuuauug

SEQ ID NO: 1383190 - RNA, 18 nt, Human
ucgggcacugaggcgcug

SEQ ID NO: 1383191 - RNA, 22 nt, Human
ucuggcgcuguccgcuggucuu

SEQ ID NO: 1383192 - RNA, 21 nt, Human
ucuguggaggccugggagccu

SEQ ID NO: 1383193 - RNA, 19 nt, Human
ugcccgacgcuggcccugg

SEQ ID NO: 1383194 - RNA, 28 nt, Human
ugccuggacccgagggacuggcaggggc

SEQ ID NO: 1383195 - RNA, 24 nt, Human
ugcugcaggcacgggggccugugg

SEQ ID NO: 1383196 - RNA, 19 nt, Human
ugcugggagacuggaccau

SEQ ID NO: 1383197 - RNA, 18 nt, Human
ugcuggggggcugcgugg

SEQ ID NO: 1383198 - RNA, 21 nt, Human
uggaggugacguuggguggcu

SEQ ID NO: 1383199 - RNA, 24 nt, Human
uggcaggggcugcuguugggggau

SEQ ID NO: 1383200 - RNA, 26 nt, Human
uggcaggggcugcuguugggggaugc

SEQ ID NO: 1383201 - RNA, 22 nt, Human
uggcugcaggggccccgaggac

SEQ ID NO: 1383202 - RNA, 23 nt, Human
uggcugcaggggccccgaggacg

SEQ ID NO: 1383203 - RNA, 25 nt, Human
uggcugcaggggccccgaggacggg

SEQ ID NO: 1383204 - RNA, 22 nt, Human
ugggagccuggcgcggcccccu

SEQ ID NO: 1383205 - RNA, 20 nt, Human
ugggaggggcuggaggaagu

SEQ ID NO: 1383206 - RNA, 21 nt, Human
ugggaggggcuggaggaagua

SEQ ID NO: 1383207 - RNA, 21 nt, Human
ugugguguggccagcugcagg

SEQ ID NO: 1383208 - RNA, 23 nt, Human
uguugcugcugcugggagacugg

SEQ ID NO: 1383209 - RNA, 22 nt, Human
uucgacgauuccuucuggcgcu

SEQ ID NO: 1383210 - RNA, 23 nt, Human
uugcuggggggcugcguggggau

SEQ ID NO: 1383211 - RNA, 21 nt, Human
uuuaaggagacccccagggcc

SEQ ID NO: 1383212 - RNA, 19 nt, Human
uuucgacgauuccuucugg

SEQ ID NO: 1383213 - RNA, 21 nt, Human
uuuuuuuuuuuuuugguccgg

SEQ ID NO: 1383214 - RNA, 18 nt, Human
uuuuuuuuuuuuuuuuug

SEQ ID NO: 1383215 - RNA, 18 nt, Human
uuuuuuuuuuuuuuuuug

SEQ ID NO: 1383216 - RNA, 25 nt, Human
uuuuuuuuuuuuuuuuugguccggg

SEQ ID NO: 1383217 - RNA, 22 nt, Human
aaaauucuuuugcccguggcca

SEQ ID NO: 1383218 - RNA, 19 nt, Human
aacauggugaaaccccguc

SEQ ID NO: 1383219 - RNA, 20 nt, Human
aacauggugaaaccccgucu

SEQ ID NO: 1383220 - RNA, 21 nt, Human
aacauggugaaaccccgucuc

SEQ ID NO: 1383221 - RNA, 20 nt, Human
aacauggugaaacccugucu

SEQ ID NO: 1383222 - RNA, 21 nt, Human
aacauggugaaacccugucuc

SEQ ID NO: 1383223 - RNA, 22 nt, Human
aagaacguuccggaagcugggg

SEQ ID NO: 1383224 - RNA, 25 nt, Human
aagaagaagaaaaaaaaguacacaa

SEQ ID NO: 1383225 - RNA, 20 nt, Human
aagaagaagaagaaaaaaaa

SEQ ID NO: 1383226 - RNA, 22 nt, Human
aagaagaagaagaaaaaaaagu

SEQ ID NO: 1383227 - RNA, 19 nt, Human
aauaucuucaaaugaacgg

SEQ ID NO: 1383228 - RNA, 22 nt, Human
accauugcacuccagccugggc

SEQ ID NO: 1383229 - RNA, 24 nt, Human
acccugucucuacuaaaaguacaa

SEQ ID NO: 1383230 - RNA, 18 nt, Human
agaagaaaaaaaaguaca

SEQ ID NO: 1383231 - RNA, 20 nt, Human
agaagaagaagaaaaaaaag

SEQ ID NO: 1383232 - RNA, 24 nt, Human
agcacuuugggaggccgagguggg

SEQ ID NO: 1383233 - RNA, 22 nt, Human
agccuggcuaacauggugaaac

SEQ ID NO: 1383234 - RNA, 24 nt, Human
agccuggcuaacauggugaaaccc

SEQ ID NO: 1383235 - RNA, 19 nt, Human
aggaggagguugcggugag

SEQ ID NO: 1383236 - RNA, 24 nt, Human
aggaggagguugcggugagccaag

SEQ ID NO: 1383237 - RNA, 20 nt, Human
aggcacgggcccugggugug

SEQ ID NO: 1383238 - RNA, 24 nt, Human
aggcacgguggcucaugccuguaa

SEQ ID NO: 1383239 - RNA, 19 nt, Human
aggcagagcuugcagugag

SEQ ID NO: 1383240 - RNA, 20 nt, Human
aggcagagcuugcagugagc

SEQ ID NO: 1383241 - RNA, 24 nt, Human
aggcagagcuugcagugagcagag

SEQ ID NO: 1383242 - RNA, 19 nt, Human
aggccgaggugggggauca

SEQ ID NO: 1383243 - RNA, 23 nt, Human
aggccgaggugggggaucacuug

SEQ ID NO: 1383244 - RNA, 21 nt, Human
aggcgaggggcauccccgggg

SEQ ID NO: 1383245 - RNA, 23 nt, Human
aggcugaggcuggagaaucuauu

SEQ ID NO: 1383246 - RNA, 24 nt, Human
aggcuggagaaucuauugaacccg

SEQ ID NO: 1383247 - RNA, 24 nt, Human
agggacagcaaggcacgggcccug

SEQ ID NO: 1383248 - RNA, 19 nt, Human
agggcugucccugucugcc

SEQ ID NO: 1383249 - RNA, 19 nt, Human
augccuguaaucccagcac

SEQ ID NO: 1383250 - RNA, 24 nt, Human
auugcacuccagccugggcaacaa

SEQ ID NO: 1383251 - RNA, 24 nt, Human
caacauggugaaacccugucucua

SEQ ID NO: 1383252 - RNA, 24 nt, Human
caccauugcacuccagccugggca

SEQ ID NO: 1383253 - RNA, 23 nt, Human
caccuccgggcuccuggagauuu

SEQ ID NO: 1383254 - RNA, 24 nt, Human
cacuccagccugggcaacaagagc

SEQ ID NO: 1383255 - RNA, 25 nt, Human
cacuccagccugggcaacaagagcg

SEQ ID NO: 1383256 - RNA, 24 nt, Human
cagcacuuugggaggccgaggugg

SEQ ID NO: 1383257 - RNA, 20 nt, Human
caugccuguaaucccagcac

SEQ ID NO: 1383258 - RNA, 24 nt, Human
caugccuguaaucccagcacuuug

SEQ ID NO: 1383259 - RNA, 18 nt, Human
cauugcacuccagccugg

SEQ ID NO: 1383260 - RNA, 19 nt, Human
cauugcacuccagccuggg

SEQ ID NO: 1383261 - RNA, 21 nt, Human
cauugcacuccagccugggca

SEQ ID NO: 1383262 - RNA, 23 nt, Human
cauugcacuccagccugggcaac

SEQ ID NO: 1383263 - RNA, 24 nt, Human
cauugcacuccagccugggcaaca

SEQ ID NO: 1383264 - RNA, 22 nt, Human
ccaugccgaagaagaagaagaa

SEQ ID NO: 1383265 - RNA, 20 nt, Human
ccauugcacuccagccuggg

SEQ ID NO: 1383266 - RNA, 21 nt, Human
ccauugcacuccagccugggc

SEQ ID NO: 1383267 - RNA, 23 nt, Human
ccauugcacuccagccugggcaa

SEQ ID NO: 1383268 - RNA, 24 nt, Human
ccauugcacuccagccugggcaac

SEQ ID NO: 1383269 - RNA, 22 nt, Human
cccagccacccgcuaccagaaa

SEQ ID NO: 1383270 - RNA, 24 nt, Human
cccgucucuacugggggugguggc

SEQ ID NO: 1383271 - RNA, 22 nt, Human
cccguggccaacauggugaaac

SEQ ID NO: 1383272 - RNA, 21 nt, Human
cccuggaugggcacuugacuu

SEQ ID NO: 1383273 - RNA, 19 nt, Human
ccgaagaagaagaagaaaa

SEQ ID NO: 1383274 - RNA, 23 nt, Human
ccuggcuaacauggugaaacccc

SEQ ID NO: 1383275 - RNA, 24 nt, Human
ccuggcuaacauggugaaaccccg

SEQ ID NO: 1383276 - RNA, 19 nt, Human
ccuguaaucucagcuacuu

SEQ ID NO: 1383277 - RNA, 21 nt, Human
ccuguaaucucagcuacuugg

SEQ ID NO: 1383278 - RNA, 27 nt, Human
ccugucugccugggucugggggcugca

SEQ ID NO: 1383279 - RNA, 25 nt, Human
cgaaacuccaugccgaagaagaaga

SEQ ID NO: 1383280 - RNA, 23 nt, Human
cgaggugggggaucacuugaggu

SEQ ID NO: 1383281 - RNA, 25 nt, Human
cgaggugggggaucacuugagguca

SEQ ID NO: 1383282 - RNA, 22 nt, Human
cgcccguaaucucagcuacuca

SEQ ID NO: 1383283 - RNA, 24 nt, Human
cgggagcccugugguccguguggc

SEQ ID NO: 1383284 - RNA, 21 nt, Human
cgggaggaggagguugcggug

SEQ ID NO: 1383285 - RNA, 24 nt, Human
cgggaggaggagguugcggugagc

SEQ ID NO: 1383286 - RNA, 24 nt, Human
cguggccaacauggugaaacccug

SEQ ID NO: 1383287 - RNA, 24 nt, Human
cucaugccuguaaucccagcacuu

SEQ ID NO: 1383288 - RNA, 19 nt, Human
cuggagauuugcugugaca

SEQ ID NO: 1383289 - RNA, 21 nt, Human
cuuugggaggccgaggugggg

SEQ ID NO: 1383290 - RNA, 19 nt, Human
gaaacccugucucuacuaa

SEQ ID NO: 1383291 - RNA, 19 nt, Human
gaagaagaagaagaaaaaa

SEQ ID NO: 1383292 - RNA, 22 nt, Human
gaggugggggaucacuugaggu

SEQ ID NO: 1383293 - RNA, 23 nt, Human
gaggugggggaucacuugagguc

SEQ ID NO: 1383294 - RNA, 23 nt, Human
gagguugcggugagccaaguuug

SEQ ID NO: 1383295 - RNA, 18 nt, Human
gaucacuugaggucagga

SEQ ID NO: 1383296 - RNA, 23 nt, Human
gaucacuugaggucaggaguucg

SEQ ID NO: 1383297 - RNA, 24 nt, Human
gaucacuugaggucaggaguucgu

SEQ ID NO: 1383298 - RNA, 20 nt, Human
gcagggacagcaaggcacgg

SEQ ID NO: 1383299 - RNA, 24 nt, Human
gccaacauggugaaacccugucuc

SEQ ID NO: 1383300 - RNA, 20 nt, Human
gccuguaaucucagcuacuu

SEQ ID NO: 1383301 - RNA, 24 nt, Human
gcuaacauggugaaaccccgucuc

SEQ ID NO: 1383302 - RNA, 18 nt, Human
ggagaggcaugaugcccc

SEQ ID NO: 1383303 - RNA, 18 nt, Human
ggagguugcggugagcca

SEQ ID NO: 1383304 - RNA, 20 nt, Human
ggagguugcggugagccaag

SEQ ID NO: 1383305 - RNA, 24 nt, Human
ggagguugcggugagccaaguuug

SEQ ID NO: 1383306 - RNA, 23 nt, Human
ggaucacuugaggucaggaguuc

SEQ ID NO: 1383307 - RNA, 20 nt, Human
ggccgagggcugggaggugc

SEQ ID NO: 1383308 - RNA, 21 nt, Human
ggccgagggcugggaggugca

SEQ ID NO: 1383309 - RNA, 21 nt, Human
ggcucaugccuguaaucccag

SEQ ID NO: 1383310 - RNA, 23 nt, Human
gggagaauggcgugaacccagga

SEQ ID NO: 1383311 - RNA, 24 nt, Human
gggaucacuugaggucaggaguuc

SEQ ID NO: 1383312 - RNA, 21 nt, Human
gggccgagggcugggaggugc

SEQ ID NO: 1383313 - RNA, 19 nt, Human
gggcgcccguaaucucagc

SEQ ID NO: 1383314 - RNA, 24 nt, Human
ggggaucacuugaggucaggaguu

SEQ ID NO: 1383315 - RNA, 23 nt, Human
ggggugguggcauaugccuguaa

SEQ ID NO: 1383316 - RNA, 22 nt, Human
gguccguguggcugggccgagg

SEQ ID NO: 1383317 - RNA, 21 nt, Human
ggugaggcacgguggcucaug

SEQ ID NO: 1383318 - RNA, 24 nt, Human
gguggcauaugccuguaaucucag

SEQ ID NO: 1383319 - RNA, 23 nt, Human
gguggcucaugccuguaauccca

SEQ ID NO: 1383320 - RNA, 24 nt, Human
gguggcucaugccuguaaucccag

SEQ ID NO: 1383321 - RNA, 20 nt, Human
ggugugguggcgggcgcccg

SEQ ID NO: 1383322 - RNA, 21 nt, Human
guugcugagacucgggagccc

SEQ ID NO: 1383323 - RNA, 21 nt, Human
uaaaaguacaaagauuagcug

SEQ ID NO: 1383324 - RNA, 22 nt, Human
uaacauggugaaaccccgucuc

SEQ ID NO: 1383325 - RNA, 24 nt, Human
uaacauggugaaaccccgucucua

SEQ ID NO: 1383326 - RNA, 21 nt, Human
uacacaauucuggugaggcac

SEQ ID NO: 1383327 - RNA, 22 nt, Human
ucaugccuguaaucccagcacu

SEQ ID NO: 1383328 - RNA, 23 nt, Human
uccaugccgaagaagaagaagaa

SEQ ID NO: 1383329 - RNA, 26 nt, Human
uccaugggcaccuccgggcuccugga

SEQ ID NO: 1383330 - RNA, 19 nt, Human
uccccggggaucuuugcgg

SEQ ID NO: 1383331 - RNA, 20 nt, Human
ucucagcuacucagcaggcu

SEQ ID NO: 1383332 - RNA, 22 nt, Human
ucucauauuauuugcccucaac

SEQ ID NO: 1383333 - RNA, 23 nt, Human
ucucuacuaaaaguacaaagauu

SEQ ID NO: 1383334 - RNA, 19 nt, Human
ucuggugaggcacgguggc

SEQ ID NO: 1383335 - RNA, 23 nt, Human
ugaggagggagaauggcgugaac

SEQ ID NO: 1383336 - RNA, 24 nt, Human
ugaggcuggagaaucuauugaacc

SEQ ID NO: 1383337 - RNA, 21 nt, Human
ugaggucaggaguucgugacc

SEQ ID NO: 1383338 - RNA, 21 nt, Human
ugcaccauugcacuccagccu

SEQ ID NO: 1383339 - RNA, 19 nt, Human
ugcacuccagccugggcaa

SEQ ID NO: 1383340 - RNA, 22 nt, Human
ugcacuccagccugggcaacaa

SEQ ID NO: 1383341 - RNA, 21 nt, Human
ugcagggacagcaaggcacgg

SEQ ID NO: 1383342 - RNA, 22 nt, Human
ugccugggucugggggcugcag

SEQ ID NO: 1383343 - RNA, 27 nt, Human
ugccugggucugggggcugcagggaca

SEQ ID NO: 1383344 - RNA, 23 nt, Human
ugccuguaaucccagcacuuugg

SEQ ID NO: 1383345 - RNA, 23 nt, Human
ugccuguaaucccagcacuuugg

SEQ ID NO: 1383346 - RNA, 24 nt, Human
ugccuguaaucccagcacuuuggg

SEQ ID NO: 1383347 - RNA, 23 nt, Human
ugccuguaaucucagcuacuugg

SEQ ID NO: 1383348 - RNA, 24 nt, Human
ugccuguaaucucagcuacuuggg

SEQ ID NO: 1383349 - RNA, 21 nt, Human
ugcgguggcgagugugugcgg

SEQ ID NO: 1383350 - RNA, 21 nt, Human
ugcgguggucagaagggcugu

SEQ ID NO: 1383351 - RNA, 21 nt, Human
uggcauaugccuguaaucuca

SEQ ID NO: 1383352 - RNA, 22 nt, Human
uggcauaugccuguaaucucag

SEQ ID NO: 1383353 - RNA, 20 nt, Human
uggccaacauggugaaaccc

SEQ ID NO: 1383354 - RNA, 20 nt, Human
uggccaacauggugaaaccc

SEQ ID NO: 1383355 - RNA, 23 nt, Human
uggccaacauggugaaacccugu

SEQ ID NO: 1383356 - RNA, 24 nt, Human
uggccaacauggugaaacccuguc

SEQ ID NO: 1383357 - RNA, 22 nt, Human
uggcucaugccuguaaucccag

SEQ ID NO: 1383358 - RNA, 24 nt, Human
uggcucaugccuguaaucccagca

SEQ ID NO: 1383359 - RNA, 20 nt, Human
uggcugggccgagggcuggg

SEQ ID NO: 1383360 - RNA, 23 nt, Human
ugggaggccgaggugggggauca

SEQ ID NO: 1383361 - RNA, 18 nt, Human
ugggaggcugaggaggga

SEQ ID NO: 1383362 - RNA, 18 nt, Human
ugggggugguggcauaug

SEQ ID NO: 1383363 - RNA, 24 nt, Human
ugguggcauaugccuguaaucuca

SEQ ID NO: 1383364 - RNA, 20 nt, Human
ugucccugucugccuggguc

SEQ ID NO: 1383365 - RNA, 22 nt, Human
uguccgaaagaacguuccggaa

SEQ ID NO: 1383366 - RNA, 18 nt, Human
uuagcugggugugguggc

SEQ ID NO: 1383367 - RNA, 24 nt, Human
uuagcugggugugguggcgggcgc

SEQ ID NO: 1383368 - RNA, 23 nt, Human
uugcaccauugcacuccagccug

SEQ ID NO: 1383369 - RNA, 22 nt, Human
uugcggugagccaaguuugcac

SEQ ID NO: 1383370 - RNA, 24 nt, Human
uugggaggccgaggugggggauca

SEQ ID NO: 1383371 - RNA, 24 nt, Human
uuugcaccauugcacuccagccug

SEQ ID NO: 1383372 - RNA, 21 nt, Human
uuugcugugacagccaugagg

SEQ ID NO: 1383373 - RNA, 23 nt, Human
uuuguggucucauauuauuugcc

SEQ ID NO: 1383374 - RNA, 19 nt, Human
aaaaaaaaaaaaagacaag

SEQ ID NO: 1383375 - RNA, 26 nt, Human
aaaaaaaagacaaguauugguaagga

SEQ ID NO: 1383376 - RNA, 22 nt, Human
aaaaaaagacaaguauugguaa

SEQ ID NO: 1383377 - RNA, 24 nt, Human
aaaacaccaaaagcaauggaaaca

SEQ ID NO: 1383378 - RNA, 23 nt, Human
aaaaugaacuagaaacuugaaua

SEQ ID NO: 1383379 - RNA, 19 nt, Human
aaacaaaagccaaaauuga

SEQ ID NO: 1383380 - RNA, 20 nt, Human
aaacaaaagccaaaauugac

SEQ ID NO: 1383381 - RNA, 22 nt, Human
aaacaaaagccaaaauugacaa

SEQ ID NO: 1383382 - RNA, 27 nt, Human
aaacuaccaucagagugaacaggcaag

SEQ ID NO: 1383383 - RNA, 21 nt, Human
aaagcaauggaaacaaaagcc

SEQ ID NO: 1383384 - RNA, 23 nt, Human
aaagcaauggaaacaaaagccaa

SEQ ID NO: 1383385 - RNA, 19 nt, Human
aaaguccaaugucauuagu

SEQ ID NO: 1383386 - RNA, 24 nt, Human
aacaacucaauagcaaaaagcaaa

SEQ ID NO: 1383387 - RNA, 21 nt, Human
aacccuagaagaaaaccuagg

SEQ ID NO: 1383388 - RNA, 21 nt, Human
aaccuacaaaaugggagaaaa

SEQ ID NO: 1383389 - RNA, 19 nt, Human
aagaaacaacacaaaagca

SEQ ID NO: 1383390 - RNA, 19 nt, Human
aagcaauggaaacaaaagc

SEQ ID NO: 1383391 - RNA, 22 nt, Human
aagcaauggaaacaaaagccaa

SEQ ID NO: 1383392 - RNA, 23 nt, Human
aagcaauggaaacaaaagccaaa

SEQ ID NO: 1383393 - RNA, 24 nt, Human
aauuauuuauuuuauuauuauuau

SEQ ID NO: 1383394 - RNA, 18 nt, Human
acaaaauaugaaacaaaa

SEQ ID NO: 1383395 - RNA, 20 nt, Human
acaacacaaaagcaacuuac

SEQ ID NO: 1383396 - RNA, 24 nt, Human
acagcaaaagaaacuaccaucaga

SEQ ID NO: 1383397 - RNA, 19 nt, Human
acagcuaugggaaaaagua

SEQ ID NO: 1383398 - RNA, 25 nt, Human
accugugccaugcuggugugcugca

SEQ ID NO: 1383399 - RNA, 18 nt, Human
agaaacaacacaaaagca

SEQ ID NO: 1383400 - RNA, 24 nt, Human
agagugaacaggcaaccuacaaaa

SEQ ID NO: 1383401 - RNA, 21 nt, Human
agcaaaaagcaaauaauccaa

SEQ ID NO: 1383402 - RNA, 24 nt, Human
agcaauggaaacaaaagccaaaaa

SEQ ID NO: 1383403 - RNA, 21 nt, Human
aggccgagguagguggaucac

SEQ ID NO: 1383404 - RNA, 22 nt, Human
aggccgggugcgguggcccaug

SEQ ID NO: 1383405 - RNA, 22 nt, Human
agguagguggaucaccugaggu

SEQ ID NO: 1383406 - RNA, 26 nt, Human
agguagguggaucaccugaggucagg

SEQ ID NO: 1383407 - RNA, 22 nt, Human
agguggaaaugcaaaaugguac

SEQ ID NO: 1383408 - RNA, 22 nt, Human
agguggaucaccugaggucagg

SEQ ID NO: 1383409 - RNA, 27 nt, Human
augaaacaaaaauauaagaaucccauu

SEQ ID NO: 1383410 - RNA, 21 nt, Human
augucuaaaacaccaaaagca

SEQ ID NO: 1383411 - RNA, 22 nt, Human
caaaagccaaaauugacaaaug

SEQ ID NO: 1383412 - RNA, 20 nt, Human
caaaauggauuaaagacuua

SEQ ID NO: 1383413 - RNA, 24 nt, Human
caaaauggauuaaagacuuaaacg

SEQ ID NO: 1383414 - RNA, 24 nt, Human
caaaugggaucuaauuaaacuaaa

SEQ ID NO: 1383415 - RNA, 21 nt, Human
caacacuuugagaggccgagg

SEQ ID NO: 1383416 - RNA, 21 nt, Human
caacucaauagcaaaaagcaa

SEQ ID NO: 1383417 - RNA, 24 nt, Human
caaggacuucaugucuaaaacacc

SEQ ID NO: 1383418 - RNA, 21 nt, Human
caauggaaacaaaagccaaaa

SEQ ID NO: 1383419 - RNA, 22 nt, Human
cacaacaguccccagaguguga

SEQ ID NO: 1383420 - RNA, 22 nt, Human
cagcaaaagaaacuaccaucag

SEQ ID NO: 1383421 - RNA, 22 nt, Human
cagggaaaugcaaaucaaaacu

SEQ ID NO: 1383422 - RNA, 25 nt, Human
cauaaaaacccuagaagaaaaccua

SEQ ID NO: 1383423 - RNA, 25 nt, Human
cauacagguggccagcagauauaua

SEQ ID NO: 1383424 - RNA, 24 nt, Human
caugcuuguaacuccaacacuuug

SEQ ID NO: 1383425 - RNA, 18 nt, Human
caugugcagaaugugcag

SEQ ID NO: 1383426 - RNA, 19 nt, Human
ccaggauggcuauuaaaaa

SEQ ID NO: 1383427 - RNA, 26 nt, Human
ccccauuucuuuauauucaacugaau

SEQ ID NO: 1383428 - RNA, 18 nt, Human
cccccacaacagucccca

SEQ ID NO: 1383429 - RNA, 25 nt, Human
cccccacaacaguccccagagugug

SEQ ID NO: 1383430 - RNA, 19 nt, Human
cccccaucuccccccccca

SEQ ID NO: 1383431 - RNA, 21 nt, Human
cccccaucucccccccccaca

SEQ ID NO: 1383432 - RNA, 23 nt, Human
ccccccacaacaguccccagagu

SEQ ID NO: 1383433 - RNA, 22 nt, Human
ccccccccacaacaguccccag

SEQ ID NO: 1383434 - RNA, 23 nt, Human
cccucccccaucuccccccccca

SEQ ID NO: 1383435 - RNA, 23 nt, Human
ccucccccaucucccccccccaa

SEQ ID NO: 1383436 - RNA, 21 nt, Human
ccugaggucaggagucgagac

SEQ ID NO: 1383437 - RNA, 20 nt, Human
cgagguagguggaucaccug

SEQ ID NO: 1383438 - RNA, 24 nt, Human
cgagguagguggaucaccugaggu

SEQ ID NO: 1383439 - RNA, 26 nt, Human
cgagguagguggaucaccugagguca

SEQ ID NO: 1383440 - RNA, 18 nt, Human
cuaaaaccauaaaaaccc

SEQ ID NO: 1383441 - RNA, 19 nt, Human
cuaaaaccauaaaaacccu

SEQ ID NO: 1383442 - RNA, 19 nt, Human
cucaaacaacucaauagca

SEQ ID NO: 1383443 - RNA, 20 nt, Human
cuccaacacuuugagaggcc

SEQ ID NO: 1383444 - RNA, 21 nt, Human
cucccccccccacaacagucc

SEQ ID NO: 1383445 - RNA, 23 nt, Human
cuccuaaugcuaucccuccccca

SEQ ID NO: 1383446 - RNA, 24 nt, Human
cugcacccauuaacucgucauuua

SEQ ID NO: 1383447 - RNA, 25 nt, Human
gaaaaaguacaaaguuuccucaaaa

SEQ ID NO: 1383448 - RNA, 23 nt, Human
gaaacuaccaucagagugaacag

SEQ ID NO: 1383449 - RNA, 19 nt, Human
gaccuaaaaccauaaaaac

SEQ ID NO: 1383450 - RNA, 23 nt, Human
gagguagguggaucaccugaggu

SEQ ID NO: 1383451 - RNA, 18 nt, Human
gauaaggaacucaaacaa

SEQ ID NO: 1383452 - RNA, 19 nt, Human
gauauauaaaaaaaagucc

SEQ ID NO: 1383453 - RNA, 23 nt, Human
gaucaccugaggucaggagucga

SEQ ID NO: 1383454 - RNA, 24 nt, Human
gauguuucuccaaagaagacauac

SEQ ID NO: 1383455 - RNA, 19 nt, Human
gcaauggaaacaaaagcca

SEQ ID NO: 1383456 - RNA, 20 nt, Human
ggcuauuaaaaaaaaaaaaa

SEQ ID NO: 1383457 - RNA, 24 nt, Human
gggugcgguggcccaugcuuguaa

SEQ ID NO: 1383458 - RNA, 20 nt, Human
uaaaacaccaaaagcaaugg

SEQ ID NO: 1383459 - RNA, 21 nt, Human
uaagaaacaacacaaaagcaa

SEQ ID NO: 1383460 - RNA, 19 nt, Human
uaagauagcuaauuucaug

SEQ ID NO: 1383461 - RNA, 21 nt, Human
uacaagaaaaaaacaaacaac

SEQ ID NO: 1383462 - RNA, 26 nt, Human
uaccugugccaugcuggugugcugca

SEQ ID NO: 1383463 - RNA, 20 nt, Human
uagcaaaaagcaaauaaucc

SEQ ID NO: 1383464 - RNA, 24 nt, Human
uagguggaucaccugaggucagga

SEQ ID NO: 1383465 - RNA, 24 nt, Human
uaucaccuuacaucugccaggaug

SEQ ID NO: 1383466 - RNA, 19 nt, Human
uauccagaaucuacaauga

SEQ ID NO: 1383467 - RNA, 22 nt, Human
uaucccucccccaucucccccc

SEQ ID NO: 1383468 - RNA, 25 nt, Human
ucaaaauagauaaggaacucaaaca

SEQ ID NO: 1383469 - RNA, 20 nt, Human
ucacaaguuggccuuuuuuu

SEQ ID NO: 1383470 - RNA, 23 nt, Human
ucccccaucucccccccccacaa

SEQ ID NO: 1383471 - RNA, 25 nt, Human
uccuaaugcuaucccucccccaucu

SEQ ID NO: 1383472 - RNA, 23 nt, Human
ucuccuaaugcuaucccuccccc

SEQ ID NO: 1383473 - RNA, 24 nt, Human
ucugacaaagggcuaauauccaga

SEQ ID NO: 1383474 - RNA, 22 nt, Human
ucugcacagcaaaagaaacuac

SEQ ID NO: 1383475 - RNA, 18 nt, Human
ugaaauaucaccuuacau

SEQ ID NO: 1383476 - RNA, 22 nt, Human
ugaacaggcaaccuacaaaaug

SEQ ID NO: 1383477 - RNA, 19 nt, Human
ugacaaagggcuaauaucc

SEQ ID NO: 1383478 - RNA, 18 nt, Human
ugacauauguauaccugu

SEQ ID NO: 1383479 - RNA, 19 nt, Human
ugagaggccgagguaggug

SEQ ID NO: 1383480 - RNA, 24 nt, Human
ugagaggccgagguagguggauca

SEQ ID NO: 1383481 - RNA, 23 nt, Human
ugcuggugugcugcacccauuaa

SEQ ID NO: 1383482 - RNA, 18 nt, Human
uggagaaacuggaacucu

SEQ ID NO: 1383483 - RNA, 23 nt, Human
uggaucaccugaggucaggaguc

SEQ ID NO: 1383484 - RNA, 27 nt, Human
uggaucaccugaggucaggagucgaga

SEQ ID NO: 1383485 - RNA, 23 nt, Human
uggcccaugcuuguaacuccaac

SEQ ID NO: 1383486 - RNA, 22 nt, Human
ugggagaaaauuuucgcaaccu

SEQ ID NO: 1383487 - RNA, 22 nt, Human
ugucauaagaaacaacacaaaa

SEQ ID NO: 1383488 - RNA, 19 nt, Human
ugucuaaaacaccaaaagc

SEQ ID NO: 1383489 - RNA, 19 nt, Human
ugugcagaaugugcagguu

SEQ ID NO: 1383490 - RNA, 22 nt, Human
uguggagaaacuggaacucuug

SEQ ID NO: 1383491 - RNA, 21 nt, Human
uucaaaauagauaaggaacuc

SEQ ID NO: 1383492 - RNA, 25 nt, Human
uucaggacauaggcaugggcaagga

SEQ ID NO: 1383493 - RNA, 22 nt, Human
uucgcaaccuacucaucugacc

SEQ ID NO: 1383494 - RNA, 21 nt, Human
uugaauagauguuucuccaaa

SEQ ID NO: 1383495 - RNA, 27 nt, Human
caggauugggacuuuccccugaggccu

SEQ ID NO: 1383496 - RNA, 22 nt, Human
cuccuccaagcuguggccucaa

SEQ ID NO: 1383497 - RNA, 19 nt, Human
uaagagagauugugucagg

SEQ ID NO: 1383498 - RNA, 26 nt, Human
ugggagggucccucaggauugggacu

SEQ ID NO: 1383499 - RNA, 22 nt, Human
uuccccugaggccucuaggcuc

SEQ ID NO: 1383500 - RNA, 19 nt, Human
aaauucuaacaugcucuuc

SEQ ID NO: 1383501 - RNA, 24 nt, Human
aaggcaaaauauguuuauuacaga

SEQ ID NO: 1383502 - RNA, 18 nt, Human
aggcaacaugagaucaac

SEQ ID NO: 1383503 - RNA, 19 nt, Human
caacaugagaucaaccauu

SEQ ID NO: 1383504 - RNA, 23 nt, Human
caauuaccgagccaacauucagc

SEQ ID NO: 1383505 - RNA, 18 nt, Human
cccgggaggaagcucugg

SEQ ID NO: 1383506 - RNA, 20 nt, Human
ccgccggcagcgccucuucu

SEQ ID NO: 1383507 - RNA, 19 nt, Human
ccggagggaccggcuggca

SEQ ID NO: 1383508 - RNA, 20 nt, Human
cgggaggaagcucuggagcg

SEQ ID NO: 1383509 - RNA, 21 nt, Human
cuccgcggcccggccguccgc

SEQ ID NO: 1383510 - RNA, 19 nt, Human
cuggagcggccgcuccucu

SEQ ID NO: 1383511 - RNA, 27 nt, Human
gaccggcuggcaggcgggucggacccc

SEQ ID NO: 1383512 - RNA, 19 nt, Human
gcaggcggguggggguggc

SEQ ID NO: 1383513 - RNA, 20 nt, Human
gccccgggaggaagcucugg

SEQ ID NO: 1383514 - RNA, 18 nt, Human
ggguggggguggcggugg

SEQ ID NO: 1383515 - RNA, 24 nt, Human
ucaauuaccgagccaacauucagc

SEQ ID NO: 1383516 - RNA, 18 nt, Human
ugaaguguagcuuugaaa

SEQ ID NO: 1383517 - RNA, 18 nt, Human
ugaggggggcgccccggg

SEQ ID NO: 1383518 - RNA, 19 nt, Human
ugaggggggcgccccggga

SEQ ID NO: 1383519 - RNA, 24 nt, Human
uuaaaguaagcaaggcaacaugag

SEQ ID NO: 1383520 - RNA, 22 nt, Human
aaauggaacaauauauugcaaa

SEQ ID NO: 1383521 - RNA, 18 nt, Human
aacagcgacgccgccccc

SEQ ID NO: 1383522 - RNA, 22 nt, Human
aaccaaaaaggacugauucagg

SEQ ID NO: 1383523 - RNA, 19 nt, Human
aagaaacacugaaccaaca

SEQ ID NO: 1383524 - RNA, 20 nt, Human
aagcaacauuaguccaaaca

SEQ ID NO: 1383525 - RNA, 22 nt, Human
aauaaaauggagaguaccuuga

SEQ ID NO: 1383526 - RNA, 23 nt, Human
aauuacuguaagagucuccaaau

SEQ ID NO: 1383527 - RNA, 21 nt, Human
accccgcccccgucccccuca

SEQ ID NO: 1383528 - RNA, 19 nt, Human
agaaaaaugugcuucugga

SEQ ID NO: 1383529 - RNA, 20 nt, Human
agcaaaaugcaaaggcugua

SEQ ID NO: 1383530 - RNA, 23 nt, Human
agcaugccaaaugugcagcuauc

SEQ ID NO: 1383531 - RNA, 22 nt, Human
aggaaacaauucauaucuucac

SEQ ID NO: 1383532 - RNA, 25 nt, Human
auuauccacuaaaauaucuauuaac

SEQ ID NO: 1383533 - RNA, 21 nt, Human
caaaaaggacugauucaggua

SEQ ID NO: 1383534 - RNA, 22 nt, Human
caaaauggaaucaaaagaaauu

SEQ ID NO: 1383535 - RNA, 18 nt, Human
caaagcuuuugucugcau

SEQ ID NO: 1383536 - RNA, 18 nt, Human
caaauguaaucaagugaa

SEQ ID NO: 1383537 - RNA, 22 nt, Human
caaauguaaucaagugaacaag

SEQ ID NO: 1383538 - RNA, 22 nt, Human
caagugaacaagaauaccagaa

SEQ ID NO: 1383539 - RNA, 22 nt, Human
caauacaacucaauuaagagua

SEQ ID NO: 1383540 - RNA, 19 nt, Human
caccccgcccccguccccc

SEQ ID NO: 1383541 - RNA, 24 nt, Human
caccccgcccccgucccccucacc

SEQ ID NO: 1383542 - RNA, 26 nt, Human
caccccgcccccgucccccucacccu

SEQ ID NO: 1383543 - RNA, 26 nt, Human
cagcuaucagucugcuugccaucagg

SEQ ID NO: 1383544 - RNA, 23 nt, Human
ccaagacucugaugccccagugg

SEQ ID NO: 1383545 - RNA, 21 nt, Human
cccagccaagacucugaugcc

SEQ ID NO: 1383546 - RNA, 19 nt, Human
cccaugggcucaauauagg

SEQ ID NO: 1383547 - RNA, 23 nt, Human
ccccaccccgcccccgucccccu

SEQ ID NO: 1383548 - RNA, 24 nt, Human
ccccaguggaaaucacuacucuuc

SEQ ID NO: 1383549 - RNA, 22 nt, Human
cccccaccccgcccccgucccc

SEQ ID NO: 1383550 - RNA, 18 nt, Human
cccccgucccccucaccc

SEQ ID NO: 1383551 - RNA, 24 nt, Human
cccgcggcuuaaaagggccggggc

SEQ ID NO: 1383552 - RNA, 29 nt, Human
ccgccgucacggccgcgaccgccccgcgg

SEQ ID NO: 1383553 - RNA, 22 nt, Human
ccuaaagccucaacuucaguag

SEQ ID NO: 1383554 - RNA, 27 nt, Human
cggcaggaggcggcggccccgcggcca

SEQ ID NO: 1383555 - RNA, 22 nt, Human
cggcguguggcggccugggugg

SEQ ID NO: 1383556 - RNA, 20 nt, Human
cgggaggggcgcggaagggg

SEQ ID NO: 1383557 - RNA, 20 nt, Human
cucuuaaccaaaauggaauc

SEQ ID NO: 1383558 - RNA, 18 nt, Human
cugaaccaacaagcagca

SEQ ID NO: 1383559 - RNA, 21 nt, Human
cugcuggaaaauggcgagggg

SEQ ID NO: 1383560 - RNA, 20 nt, Human
cuuccuuuguaaccgacucc

SEQ ID NO: 1383561 - RNA, 19 nt, Human
gaaagggcugcccccaccc

SEQ ID NO: 1383562 - RNA, 18 nt, Human
gaccgccccgcggggccg

SEQ ID NO: 1383563 - RNA, 23 nt, Human
gcaaaaugcaaaggcuguaacuu

SEQ ID NO: 1383564 - RNA, 18 nt, Human
gcaugccaaaugugcagc

SEQ ID NO: 1383565 - RNA, 23 nt, Human
gcccugcgcgcuccgguuucagc

SEQ ID NO: 1383566 - RNA, 21 nt, Human
gcugcuggaaaauggcgaggg

SEQ ID NO: 1383567 - RNA, 20 nt, Human
ggcggccccgcggcuuaaaa

SEQ ID NO: 1383568 - RNA, 19 nt, Human
gggcugcccccaccccgcc

SEQ ID NO: 1383569 - RNA, 22 nt, Human
gguaaggcaauaaaauggagag

SEQ ID NO: 1383570 - RNA, 18 nt, Human
guaaggcaauaaaaugga

SEQ ID NO: 1383571 - RNA, 21 nt, Human
uaaacaaagcaugccaaaugu

SEQ ID NO: 1383572 - RNA, 21 nt, Human
uaaggcaauaaaauggagagu

SEQ ID NO: 1383573 - RNA, 24 nt, Human
uacaaaguuaaaaacugaaucuca

SEQ ID NO: 1383574 - RNA, 26 nt, Human
uacccuaaagccucaacuucaguagc

SEQ ID NO: 1383575 - RNA, 23 nt, Human
uaguccaaacauacaacagucaa

SEQ ID NO: 1383576 - RNA, 18 nt, Human
uaucaggaaaaauacagu

SEQ ID NO: 1383577 - RNA, 27 nt, Human
uaucaggaaaaauacaguaaaggcccc

SEQ ID NO: 1383578 - RNA, 22 nt, Human
uauugcaaauccuuguaaccca

SEQ ID NO: 1383579 - RNA, 19 nt, Human
ucaaagcuuuugucugcau

SEQ ID NO: 1383580 - RNA, 18 nt, Human
uccaagauaucuaaaauc

SEQ ID NO: 1383581 - RNA, 25 nt, Human
ucuauuaccaaccaaaaaggacuga

SEQ ID NO: 1383582 - RNA, 26 nt, Human
ucucuuaaccaaaauggaaucaaaag

SEQ ID NO: 1383583 - RNA, 18 nt, Human
ugaaccaacaagcagcag

SEQ ID NO: 1383584 - RNA, 23 nt, Human
ugaaccaacaagcagcagauuca

SEQ ID NO: 1383585 - RNA, 22 nt, Human
ugcagaaaaaugugcuucugga

SEQ ID NO: 1383586 - RNA, 21 nt, Human
uggaaucaaaagaaauuaaac

SEQ ID NO: 1383587 - RNA, 20 nt, Human
uggcaauaucauaaaauggu

SEQ ID NO: 1383588 - RNA, 23 nt, Human
uggcaauaucauaaaaugguuuu

SEQ ID NO: 1383589 - RNA, 18 nt, Human
uggcggccuggguggcgc

SEQ ID NO: 1383590 - RNA, 22 nt, Human
uggguguauaaaaaaaucuauu

SEQ ID NO: 1383591 - RNA, 28 nt, Human
uguacuguggcucuuguuccgguucccc

SEQ ID NO: 1383592 - RNA, 24 nt, Human
uuaaaaacugaaucucaaagcuaa

SEQ ID NO: 1383593 - RNA, 22 nt, Human
uugugcagaaaaaugugcuucu

SEQ ID NO: 1383594 - RNA, 19 nt, Human
uuuccuaucacauuuuggc

SEQ ID NO: 1383595 - RNA, 22 nt, Human
aaaauuuuuaacauaccaagug

SEQ ID NO: 1383596 - RNA, 18 nt, Human
aacagcauuagcaacacu

SEQ ID NO: 1383597 - RNA, 19 nt, Human
aagaaaagcaauaaaaaug

SEQ ID NO: 1383598 - RNA, 23 nt, Human
aagcagaggccaggccaaugaaa

SEQ ID NO: 1383599 - RNA, 25 nt, Human
aagcagaggccaggccaaugaaaaa

SEQ ID NO: 1383600 - RNA, 24 nt, Human
aagcagggagacuuaguuguagga

SEQ ID NO: 1383601 - RNA, 22 nt, Human
aaggaggcacaaagaaggaaca

SEQ ID NO: 1383602 - RNA, 21 nt, Human
agccugagaagcagaggccag

SEQ ID NO: 1383603 - RNA, 25 nt, Human
caaaauuagaaagcagaaaacuaau

SEQ ID NO: 1383604 - RNA, 19 nt, Human
cacacaaugcacaaaggaa

SEQ ID NO: 1383605 - RNA, 19 nt, Human
caccaguaaggggccucca

SEQ ID NO: 1383606 - RNA, 21 nt, Human
cagaggccaggccaaugaaaa

SEQ ID NO: 1383607 - RNA, 21 nt, Human
caggccaaugaaaaaccagcc

SEQ ID NO: 1383608 - RNA, 25 nt, Human
caggccaaugaaaaaccagccacga

SEQ ID NO: 1383609 - RNA, 21 nt, Human
ccacacuuaagaaaauacuag

SEQ ID NO: 1383610 - RNA, 26 nt, Human
cccaacauguguaacaaaguaggauu

SEQ ID NO: 1383611 - RNA, 21 nt, Human
ccugaaaggcuacaaaccucu

SEQ ID NO: 1383612 - RNA, 18 nt, Human
cucaaagaaaggagucac

SEQ ID NO: 1383613 - RNA, 22 nt, Human
cugucucuuacccaucuuuccc

SEQ ID NO: 1383614 - RNA, 20 nt, Human
gaaaugaauaggagcaggca

SEQ ID NO: 1383615 - RNA, 22 nt, Human
gagcaaaagaaauaaucaguua

SEQ ID NO: 1383616 - RNA, 22 nt, Human
gggccuccaacccugacccuca

SEQ ID NO: 1383617 - RNA, 18 nt, Human
gugguugcaaagcuaucc

SEQ ID NO: 1383618 - RNA, 19 nt, Human
uaacaaaguaggauccccc

SEQ ID NO: 1383619 - RNA, 26 nt, Human
uaagaaaagcaauaaaaauguaaaga

SEQ ID NO: 1383620 - RNA, 18 nt, Human
uaagacuauaagaaauau

SEQ ID NO: 1383621 - RNA, 24 nt, Human
uaaggggccuccaacccugacccu

SEQ ID NO: 1383622 - RNA, 24 nt, Human
uacacaauuucuauauuguauuaa

SEQ ID NO: 1383623 - RNA, 19 nt, Human
uaccaagugccucaagagu

SEQ ID NO: 1383624 - RNA, 27 nt, Human
uagaaagcagaaaacuaguucgguuga

SEQ ID NO: 1383625 - RNA, 24 nt, Human
uaggaucccccuguaaaaccacca

SEQ ID NO: 1383626 - RNA, 18 nt, Human
uaguaaguaaauguguga

SEQ ID NO: 1383627 - RNA, 24 nt, Human
uauuaaagauccugauugaccaaa

SEQ ID NO: 1383628 - RNA, 23 nt, Human
uccccugaagacaucuuagacac

SEQ ID NO: 1383629 - RNA, 23 nt, Human
ucuuacccaucuuuccccugaag

SEQ ID NO: 1383630 - RNA, 20 nt, Human
ugaaaaaccagccacgagag

SEQ ID NO: 1383631 - RNA, 23 nt, Human
ugguuuggaaggaggcacaaaga

SEQ ID NO: 1383632 - RNA, 21 nt, Human
uucacagggacacagcuuaug

SEQ ID NO: 1383633 - RNA, 18 nt, Human
uuccugaaaauaaaaaau

SEQ ID NO: 1383634 - RNA, 20 nt, Human
aaaacaagcccacaaggaaa

SEQ ID NO: 1383635 - RNA, 26 nt, Human
aaacaggagacuggcacugcccaaag

SEQ ID NO: 1383636 - RNA, 23 nt, Human
aaaggaacaaaggccccgauuca

SEQ ID NO: 1383637 - RNA, 20 nt, Human
aacaggaauaaagaaaucug

SEQ ID NO: 1383638 - RNA, 19 nt, Human
aacauggcauuuucuggac

SEQ ID NO: 1383639 - RNA, 22 nt, Human
aacauggcauuuucuggacaca

SEQ ID NO: 1383640 - RNA, 19 nt, Human
aacccagacacccaggccu

SEQ ID NO: 1383641 - RNA, 25 nt, Human
aaguacuccucccaccucagccuuc

SEQ ID NO: 1383642 - RNA, 26 nt, Human
acaccccauuucacaacccagacacc

SEQ ID NO: 1383643 - RNA, 19 nt, Human
acaugcagaggagcugcuc

SEQ ID NO: 1383644 - RNA, 23 nt, Human
acccugggucuaucagaccucag

SEQ ID NO: 1383645 - RNA, 20 nt, Human
acgucccacaggguggagcc

SEQ ID NO: 1383646 - RNA, 19 nt, Human
acuauaaugaaggcagaau

SEQ ID NO: 1383647 - RNA, 25 nt, Human
acucuguugcccaggcuggagugca

SEQ ID NO: 1383648 - RNA, 21 nt, Human
acugcaacauaacuuagccca

SEQ ID NO: 1383649 - RNA, 25 nt, Human
agcagaaaaggaacaaaggccccga

SEQ ID NO: 1383650 - RNA, 22 nt, Human
agcaggaaucccagauccaggc

SEQ ID NO: 1383651 - RNA, 20 nt, Human
agcaugagaaauaaaacuuc

SEQ ID NO: 1383652 - RNA, 23 nt, Human
agccaccgggaaagccacccauc

SEQ ID NO: 1383653 - RNA, 21 nt, Human
agcccacaaggaaauacugcc

SEQ ID NO: 1383654 - RNA, 25 nt, Human
agcguucuucguuugcuuuuuuaga

SEQ ID NO: 1383655 - RNA, 21 nt, Human
aggaaauacugccgucuccau

SEQ ID NO: 1383656 - RNA, 19 nt, Human
aggaagcugaggcugagac

SEQ ID NO: 1383657 - RNA, 24 nt, Human
aggagacaccccauuucacaaccc

SEQ ID NO: 1383658 - RNA, 19 nt, Human
aggccuagugaagccgggc

SEQ ID NO: 1383659 - RNA, 19 nt, Human
aggcuggagugcaguggca

SEQ ID NO: 1383660 - RNA, 21 nt, Human
aggguggagccuccaucugcc

SEQ ID NO: 1383661 - RNA, 19 nt, Human
aggugcaaaccaccaugcc

SEQ ID NO: 1383662 - RNA, 21 nt, Human
agugcaguggcacaaucauag

SEQ ID NO: 1383663 - RNA, 23 nt, Human
agugcaguggcacaaucauaguu

SEQ ID NO: 1383664 - RNA, 18 nt, Human
auaguucacuguaaccuc

SEQ ID NO: 1383665 - RNA, 18 nt, Human
aucauaguucacuguaac

SEQ ID NO: 1383666 - RNA, 24 nt, Human
auguagcaugagaaauaaaacuuc

SEQ ID NO: 1383667 - RNA, 19 nt, Human
auuucacaacccagacacc

SEQ ID NO: 1383668 - RNA, 20 nt, Human
caaagcccuucuccuagcaa

SEQ ID NO: 1383669 - RNA, 24 nt, Human
caacuucugcugcuuuauugaagg

SEQ ID NO: 1383670 - RNA, 22 nt, Human
cacaacccagacacccaggccu

SEQ ID NO: 1383671 - RNA, 22 nt, Human
cacagccaggaagcaggaaucc

SEQ ID NO: 1383672 - RNA, 22 nt, Human
cacaggugcaaaccaccaugcc

SEQ ID NO: 1383673 - RNA, 20 nt, Human
caccucagccuucugaguag

SEQ ID NO: 1383674 - RNA, 24 nt, Human
cacucuguugcccaggcuggagug

SEQ ID NO: 1383675 - RNA, 19 nt, Human
cacugcaauagcucauagu

SEQ ID NO: 1383676 - RNA, 21 nt, Human
cacugcgugacacugguagau

SEQ ID NO: 1383677 - RNA, 19 nt, Human
cagaaggagaaaucugacu

SEQ ID NO: 1383678 - RNA, 24 nt, Human
cagaaugaacuuaaccuccacuaa

SEQ ID NO: 1383679 - RNA, 21 nt, Human
cagagcagcaagagccuccag

SEQ ID NO: 1383680 - RNA, 18 nt, Human
cagcagaaaaggaacaaa

SEQ ID NO: 1383681 - RNA, 24 nt, Human
cagcagaaaaggaacaaaggcccc

SEQ ID NO: 1383682 - RNA, 21 nt, Human
caggccuagugaagccgggcu

SEQ ID NO: 1383683 - RNA, 22 nt, Human
caggccuagugaagccgggcuu

SEQ ID NO: 1383684 - RNA, 18 nt, Human
caggggcucugagaaccc

SEQ ID NO: 1383685 - RNA, 19 nt, Human
cagguguuacugcaaacag

SEQ ID NO: 1383686 - RNA, 22 nt, Human
cauaagacgccauugcacccac

SEQ ID NO: 1383687 - RNA, 21 nt, Human
caucuucucugccacacagcc

SEQ ID NO: 1383688 - RNA, 21 nt, Human
cauguagcaugagaaauaaaa

SEQ ID NO: 1383689 - RNA, 22 nt, Human
cauguuacugauguagcucuuc

SEQ ID NO: 1383690 - RNA, 20 nt, Human
ccacaggugcaaaccaccau

SEQ ID NO: 1383691 - RNA, 21 nt, Human
ccacaugcagaggagcugcuc

SEQ ID NO: 1383692 - RNA, 23 nt, Human
ccaccucagccuucugaguagcu

SEQ ID NO: 1383693 - RNA, 19 nt, Human
ccaggaagcaggaauccca

SEQ ID NO: 1383694 - RNA, 25 nt, Human
ccaucugccaggggcucugagaacc

SEQ ID NO: 1383695 - RNA, 19 nt, Human
cccauguuacaggcaaagc

SEQ ID NO: 1383696 - RNA, 21 nt, Human
ccccauuucacaacccagaca

SEQ ID NO: 1383697 - RNA, 19 nt, Human
ccccgauucaaaccuggga

SEQ ID NO: 1383698 - RNA, 19 nt, Human
cccuaucuuuucuuuuaaa

SEQ ID NO: 1383699 - RNA, 21 nt, Human
cccugagccaccgggaaagcc

SEQ ID NO: 1383700 - RNA, 19 nt, Human
cccugggucuaucagaccu

SEQ ID NO: 1383701 - RNA, 19 nt, Human
ccgaagcuuucuucuuguu

SEQ ID NO: 1383702 - RNA, 22 nt, Human
ccucacucuguugcccaggcug

SEQ ID NO: 1383703 - RNA, 24 nt, Human
ccucacucuguugcccaggcugga

SEQ ID NO: 1383704 - RNA, 26 nt, Human
ccucacucuguugcccaggcuggagu

SEQ ID NO: 1383705 - RNA, 20 nt, Human
ccuccaucugccaggggcuc

SEQ ID NO: 1383706 - RNA, 24 nt, Human
ccucccaccucagccuucugagua

SEQ ID NO: 1383707 - RNA, 21 nt, Human
ccucgaacuccugggcucaag

SEQ ID NO: 1383708 - RNA, 22 nt, Human
ccucgaacuccugggcucaagu

SEQ ID NO: 1383709 - RNA, 19 nt, Human
ccugggcucaaguacuccu

SEQ ID NO: 1383710 - RNA, 24 nt, Human
ccuguggcucagagcagcaagagc

SEQ ID NO: 1383711 - RNA, 25 nt, Human
cgaacuccugggcucaaguacuccu

SEQ ID NO: 1383712 - RNA, 19 nt, Human
cucaaguacuccucccacc

SEQ ID NO: 1383713 - RNA, 24 nt, Human
cucaaguacuccucccaccucagc

SEQ ID NO: 1383714 - RNA, 24 nt, Human
cucacucuguugcccaggcuggag

SEQ ID NO: 1383715 - RNA, 18 nt, Human
cuccugggcucaaguacu

SEQ ID NO: 1383716 - RNA, 23 nt, Human
cuccugggcucaaguacuccucc

SEQ ID NO: 1383717 - RNA, 22 nt, Human
cugagaacccugagccaccggg

SEQ ID NO: 1383718 - RNA, 24 nt, Human
cuggcacugcccaaagcccuucuc

SEQ ID NO: 1383719 - RNA, 21 nt, Human
cugugaccacaggugcaaacc

SEQ ID NO: 1383720 - RNA, 21 nt, Human
cuuagcccaucccaacccagc

SEQ ID NO: 1383721 - RNA, 24 nt, Human
cuucugaguagcugugaccacagg

SEQ ID NO: 1383722 - RNA, 21 nt, Human
gaaggggaggggagggaacag

SEQ ID NO: 1383723 - RNA, 24 nt, Human
gaaugaacuuaaccuccacuaaua

SEQ ID NO: 1383724 - RNA, 19 nt, Human
gacaggaaggggaggggag

SEQ ID NO: 1383725 - RNA, 20 nt, Human
gacaggaaggggaggggagg

SEQ ID NO: 1383726 - RNA, 22 nt, Human
gacagugaugaaggacacagcc

SEQ ID NO: 1383727 - RNA, 21 nt, Human
gaccacaggugcaaaccacca

SEQ ID NO: 1383728 - RNA, 19 nt, Human
gagacuggcacugcccaaa

SEQ ID NO: 1383729 - RNA, 19 nt, Human
gcagggccagugggcugug

SEQ ID NO: 1383730 - RNA, 25 nt, Human
gcccaaagcccuucuccuagcaauc

SEQ ID NO: 1383731 - RNA, 20 nt, Human
gcccaggcuggagugcagug

SEQ ID NO: 1383732 - RNA, 19 nt, Human
gcuggagugcaguggcaca

SEQ ID NO: 1383733 - RNA, 22 nt, Human
ggaaaacccaccauguuacuga

SEQ ID NO: 1383734 - RNA, 21 nt, Human
ggaagcugaggcugagaacau

SEQ ID NO: 1383735 - RNA, 22 nt, Human
ggaauaaagaaaucuguaaaaa

SEQ ID NO: 1383736 - RNA, 21 nt, Human
ggacaggaaggggaggggagg

SEQ ID NO: 1383737 - RNA, 18 nt, Human
ggccagugggcugugugc

SEQ ID NO: 1383738 - RNA, 19 nt, Human
ggccuagugaagccgggcu

SEQ ID NO: 1383739 - RNA, 21 nt, Human
gggacagggauagggacagga

SEQ ID NO: 1383740 - RNA, 18 nt, Human
gggaggggagggaacagg

SEQ ID NO: 1383741 - RNA, 18 nt, Human
gugaccaucuuguugucc

SEQ ID NO: 1383742 - RNA, 20 nt, Human
uaaaacaagcccacaaggaa

SEQ ID NO: 1383743 - RNA, 19 nt, Human
uaaauaguucaacucaaau

SEQ ID NO: 1383744 - RNA, 24 nt, Human
uaaaucccugaccuaauaaagucc

SEQ ID NO: 1383745 - RNA, 23 nt, Human
uaacuuagcccaucccaacccag

SEQ ID NO: 1383746 - RNA, 21 nt, Human
uaagacgccauugcacccaca

SEQ ID NO: 1383747 - RNA, 23 nt, Human
uaggaugccgcagggccaguggg

SEQ ID NO: 1383748 - RNA, 20 nt, Human
uauacaagaaaaaugaacua

SEQ ID NO: 1383749 - RNA, 19 nt, Human
uauugugaaaggacaggaa

SEQ ID NO: 1383750 - RNA, 24 nt, Human
ucacucuguugcccaggcuggagu

SEQ ID NO: 1383751 - RNA, 21 nt, Human
ucacugacaccuccuggcugc

SEQ ID NO: 1383752 - RNA, 23 nt, Human
ucacuguaaccucgaacuccugg

SEQ ID NO: 1383753 - RNA, 24 nt, Human
ucacuguaaccucgaacuccuggg

SEQ ID NO: 1383754 - RNA, 22 nt, Human
ucagagcagcaagagccuccag

SEQ ID NO: 1383755 - RNA, 21 nt, Human
uccaguguguccuuccccagc

SEQ ID NO: 1383756 - RNA, 21 nt, Human
ucccacaggguggagccucca

SEQ ID NO: 1383757 - RNA, 18 nt, Human
uccccagccauaacaacu

SEQ ID NO: 1383758 - RNA, 22 nt, Human
uccuggcugcgggucacuggag

SEQ ID NO: 1383759 - RNA, 18 nt, Human
uccugggcucaaguacuc

SEQ ID NO: 1383760 - RNA, 24 nt, Human
uccugggcucaaguacuccuccca

SEQ ID NO: 1383761 - RNA, 22 nt, Human
ucuacugcucacugacuauuua

SEQ ID NO: 1383762 - RNA, 21 nt, Human
ucucugccacacagccaggaa

SEQ ID NO: 1383763 - RNA, 25 nt, Human
ucucugccacacagccaggaagcag

SEQ ID NO: 1383764 - RNA, 22 nt, Human
ucugaguagcugugaccacagg

SEQ ID NO: 1383765 - RNA, 24 nt, Human
ucugaguagcugugaccacaggug

SEQ ID NO: 1383766 - RNA, 18 nt, Human
ucuguugcccaggcugga

SEQ ID NO: 1383767 - RNA, 24 nt, Human
ucuguugcccaggcuggagugcag

SEQ ID NO: 1383768 - RNA, 20 nt, Human
ugaaaggacaggaaggggaa

SEQ ID NO: 1383769 - RNA, 23 nt, Human
ugaccaaagucauacagcagaaa

SEQ ID NO: 1383770 - RNA, 24 nt, Human
ugaccaaagucauacagcagaaaa

SEQ ID NO: 1383771 - RNA, 18 nt, Human
ugaggaaauguuucagag

SEQ ID NO: 1383772 - RNA, 28 nt, Human
ugcaaacaggagacuggcacugcccaaa

SEQ ID NO: 1383773 - RNA, 18 nt, Human
ugcccaggcuggagugca

SEQ ID NO: 1383774 - RNA, 21 nt, Human
ugcccaggcuggagugcagug

SEQ ID NO: 1383775 - RNA, 22 nt, Human
ugcccaggcuggagugcagugg

SEQ ID NO: 1383776 - RNA, 24 nt, Human
ugcccaggcuggagugcaguggca

SEQ ID NO: 1383777 - RNA, 18 nt, Human
ugcuagaaacauaugagg

SEQ ID NO: 1383778 - RNA, 19 nt, Human
ugcugggggacagggauag

SEQ ID NO: 1383779 - RNA, 20 nt, Human
ugcuuauucucaagaaauca

SEQ ID NO: 1383780 - RNA, 18 nt, Human
uggaaggagacaccccau

SEQ ID NO: 1383781 - RNA, 18 nt, Human
uggagugcaguggcacaa

SEQ ID NO: 1383782 - RNA, 19 nt, Human
uggagugcaguggcacaau

SEQ ID NO: 1383783 - RNA, 21 nt, Human
uggagugcaguggcacaauca

SEQ ID NO: 1383784 - RNA, 20 nt, Human
uggauccuuaaaacaagccc

SEQ ID NO: 1383785 - RNA, 20 nt, Human
uggcacaaucauaguucacu

SEQ ID NO: 1383786 - RNA, 24 nt, Human
uggcacaaucauaguucacuguaa

SEQ ID NO: 1383787 - RNA, 19 nt, Human
uggcauccaaggcgcagaa

SEQ ID NO: 1383788 - RNA, 19 nt, Human
ugguauagguaaggaagcu

SEQ ID NO: 1383789 - RNA, 21 nt, Human
ugucccagccugugcccaugu

SEQ ID NO: 1383790 - RNA, 18 nt, Human
ugugaaaggacaggaagg

SEQ ID NO: 1383791 - RNA, 24 nt, Human
ugugaccacaggugcaaaccacca

SEQ ID NO: 1383792 - RNA, 23 nt, Human
ugugcccauguuacaggcaaagc

SEQ ID NO: 1383793 - RNA, 19 nt, Human
uguuggagggggaaggggg

SEQ ID NO: 1383794 - RNA, 19 nt, Human
uuaaaucccugaccuaaua

SEQ ID NO: 1383795 - RNA, 21 nt, Human
uuccccagccauaacaacugg

SEQ ID NO: 1383796 - RNA, 24 nt, Human
uucugaguagcugugaccacaggu

SEQ ID NO: 1383797 - RNA, 18 nt, Human
uucugguucuccuccuuc

SEQ ID NO: 1383798 - RNA, 19 nt, Human
uucugguucuccuccuucu

SEQ ID NO: 1383799 - RNA, 22 nt, Human
uuuaccagacaaugagacugau

SEQ ID NO: 1383800 - RNA, 21 nt, Human
aagucaccgugguggagcugg

SEQ ID NO: 1383801 - RNA, 25 nt, Human
aauaagauuauugugaagauuaaga

SEQ ID NO: 1383802 - RNA, 18 nt, Human
acacaccaaaacuugaca

SEQ ID NO: 1383803 - RNA, 24 nt, Human
acaccaaaacuugacacagaaaac

SEQ ID NO: 1383804 - RNA, 19 nt, Human
acgggggcagcaugcccca

SEQ ID NO: 1383805 - RNA, 21 nt, Human
aggcaggauugggcaagugcu

SEQ ID NO: 1383806 - RNA, 21 nt, Human
auccaggugucucuacccagu

SEQ ID NO: 1383807 - RNA, 21 nt, Human
caaaucuuugugcaucagugu

SEQ ID NO: 1383808 - RNA, 24 nt, Human
caagugcucugaaaccaaaacauc

SEQ ID NO: 1383809 - RNA, 24 nt, Human
cagaaaacacuacauauuugcuau

SEQ ID NO: 1383810 - RNA, 26 nt, Human
cagcagccaugagaguucuucucuga

SEQ ID NO: 1383811 - RNA, 18 nt, Human
caggugucucuacccagu

SEQ ID NO: 1383812 - RNA, 24 nt, Human
ccaaaacaucuagauuugaauccu

SEQ ID NO: 1383813 - RNA, 20 nt, Human
ccagcagccaugagaguucu

SEQ ID NO: 1383814 - RNA, 24 nt, Human
ccagcagccaugagaguucuucuc

SEQ ID NO: 1383815 - RNA, 22 nt, Human
cccccaugcaaugggggaugga

SEQ ID NO: 1383816 - RNA, 18 nt, Human
ccgcccucaugcagggaa

SEQ ID NO: 1383817 - RNA, 18 nt, Human
ccuccagcagccaugaga

SEQ ID NO: 1383818 - RNA, 19 nt, Human
ccuccagcagccaugagag

SEQ ID NO: 1383819 - RNA, 22 nt, Human
ccuccagcagccaugagaguuc

SEQ ID NO: 1383820 - RNA, 19 nt, Human
ccuguggccaugggguggg

SEQ ID NO: 1383821 - RNA, 23 nt, Human
cugaaaccaaaacaucuagauuu

SEQ ID NO: 1383822 - RNA, 23 nt, Human
cugagguaaagacgguucucucc

SEQ ID NO: 1383823 - RNA, 18 nt, Human
cuggaggcccuaggagcu

SEQ ID NO: 1383824 - RNA, 23 nt, Human
gauaauaauaguaucuaauaaga

SEQ ID NO: 1383825 - RNA, 23 nt, Human
gcaaugggggauggagcaggggg

SEQ ID NO: 1383826 - RNA, 21 nt, Human
gcaggauugggcaagugcucu

SEQ ID NO: 1383827 - RNA, 18 nt, Human
gccagaugcccuguggcc

SEQ ID NO: 1383828 - RNA, 22 nt, Human
gggcaagugcucugaaaccaaa

SEQ ID NO: 1383829 - RNA, 18 nt, Human
ggggauggagcaggggga

SEQ ID NO: 1383830 - RNA, 23 nt, Human
gggggauggagcagggggaacuc

SEQ ID NO: 1383831 - RNA, 21 nt, Human
gucccccuucaccaagucacc

SEQ ID NO: 1383832 - RNA, 21 nt, Human
uaaaaggggauaauaauagua

SEQ ID NO: 1383833 - RNA, 27 nt, Human
uaaaugauucuuuaugcccuuccccca

SEQ ID NO: 1383834 - RNA, 23 nt, Human
uacuuuagaaaggcaggauuggg

SEQ ID NO: 1383835 - RNA, 22 nt, Human
uauugccagaugcccuguggcc

SEQ ID NO: 1383836 - RNA, 18 nt, Human
uccuaaaucuugacucca

SEQ ID NO: 1383837 - RNA, 21 nt, Human
ugaggccagacaaugucucca

SEQ ID NO: 1383838 - RNA, 21 nt, Human
ugaggccagacaaugucuccc

SEQ ID NO: 1383839 - RNA, 24 nt, Human
ugcaaugggggauggagcaggggg

SEQ ID NO: 1383840 - RNA, 22 nt, Human
ugccccaaacaccuuguccagc

SEQ ID NO: 1383841 - RNA, 18 nt, Human
ugcccuguggccaugggg

SEQ ID NO: 1383842 - RNA, 21 nt, Human
uggaggcccuaggagcugagg

SEQ ID NO: 1383843 - RNA, 19 nt, Human
uggaugagugggaggagcu

SEQ ID NO: 1383844 - RNA, 18 nt, Human
ugggaggagcugccagcg

SEQ ID NO: 1383845 - RNA, 24 nt, Human
ugggcaagugcucugaaaccaaaa

SEQ ID NO: 1383846 - RNA, 23 nt, Human
ugggcagugaggccagacaaugu

SEQ ID NO: 1383847 - RNA, 19 nt, Human
ugggggauggagcaggggg

SEQ ID NO: 1383848 - RNA, 24 nt, Human
uuagaaaggcaggauugggcaagu

SEQ ID NO: 1383849 - RNA, 20 nt, Human
uucuggcauuggucccccuu

SEQ ID NO: 1383850 - RNA, 20 nt, Human
uugccagaugcccuguggcc

SEQ ID NO: 1383851 - RNA, 18 nt, Human
uuuuuuuuuuuuuuuuug

SEQ ID NO: 1383852 - RNA, 19 nt, Human
uuuuuuuuuuuuuuuuugc

SEQ ID NO: 1383853 - RNA, 23 nt, Human
aagucuuccugagcugagcuucu

SEQ ID NO: 1383854 - RNA, 19 nt, Human
acacauuuccaaugcugcc

SEQ ID NO: 1383855 - RNA, 18 nt, Human
accauggggugccacagc

SEQ ID NO: 1383856 - RNA, 22 nt, Human
acccuggcagccgggaguucug

SEQ ID NO: 1383857 - RNA, 26 nt, Human
acuacaauuggcauugaauggaccaa

SEQ ID NO: 1383858 - RNA, 18 nt, Human
agaacacugcagacacac

SEQ ID NO: 1383859 - RNA, 24 nt, Human
agacaaaauaaccucccugugauc

SEQ ID NO: 1383860 - RNA, 20 nt, Human
agagacuguucugcacauug

SEQ ID NO: 1383861 - RNA, 20 nt, Human
agagcaggaagggccccuuc

SEQ ID NO: 1383862 - RNA, 20 nt, Human
agaguucuucccagcugcac

SEQ ID NO: 1383863 - RNA, 22 nt, Human
agaguucuucccagcugcacuc

SEQ ID NO: 1383864 - RNA, 26 nt, Human
agcaacauccugguucuuccuccggc

SEQ ID NO: 1383865 - RNA, 24 nt, Human
agcaguccggggaggccuggccuc

SEQ ID NO: 1383866 - RNA, 18 nt, Human
aggcagcaccuugcaggg

SEQ ID NO: 1383867 - RNA, 20 nt, Human
agggaagccugacccucucu

SEQ ID NO: 1383868 - RNA, 20 nt, Human
agggagcuacuucccucagc

SEQ ID NO: 1383869 - RNA, 18 nt, Human
augccucagcucugauga

SEQ ID NO: 1383870 - RNA, 25 nt, Human
caaaauaaccucccugugaucagac

SEQ ID NO: 1383871 - RNA, 21 nt, Human
caaagcggacagccaucuguc

SEQ ID NO: 1383872 - RNA, 22 nt, Human
caaagcggacagccaucugucu

SEQ ID NO: 1383873 - RNA, 22 nt, Human
caacgaugggugcccaugcaug

SEQ ID NO: 1383874 - RNA, 23 nt, Human
cagaacacugcagacacaccaug

SEQ ID NO: 1383875 - RNA, 18 nt, Human
cagcaaaacagguuuccc

SEQ ID NO: 1383876 - RNA, 26 nt, Human
caggcagcaacauccugguucuuccu

SEQ ID NO: 1383877 - RNA, 21 nt, Human
ccagaacacugcagacacacc

SEQ ID NO: 1383878 - RNA, 23 nt, Human
ccagaacacugcagacacaccau

SEQ ID NO: 1383879 - RNA, 28 nt, Human
ccaggaaaagcaggcuagcaguccgggg

SEQ ID NO: 1383880 - RNA, 24 nt, Human
cccccacagucacugugacccccu

SEQ ID NO: 1383881 - RNA, 23 nt, Human
ccccucaugcauuugugaaacag

SEQ ID NO: 1383882 - RNA, 19 nt, Human
cccuggcagccgggaguuc

SEQ ID NO: 1383883 - RNA, 21 nt, Human
ccucaacacacacacauuucc

SEQ ID NO: 1383884 - RNA, 21 nt, Human
ccugguucuuccuccggcucc

SEQ ID NO: 1383885 - RNA, 21 nt, Human
cggggaggccuggccucuccc

SEQ ID NO: 1383886 - RNA, 21 nt, Human
cugcagcacgcagaggcuugc

SEQ ID NO: 1383887 - RNA, 21 nt, Human
cuggaagucuuccugagcuga

SEQ ID NO: 1383888 - RNA, 24 nt, Human
cugguucuuccuccggcuccaggg

SEQ ID NO: 1383889 - RNA, 21 nt, Human
cuuccugagcugagcuucugc

SEQ ID NO: 1383890 - RNA, 18 nt, Human
gacacaccauggggugcc

SEQ ID NO: 1383891 - RNA, 20 nt, Human
gagcaggaagggccccuucu

SEQ ID NO: 1383892 - RNA, 18 nt, Human
gagccaagguccagggaa

SEQ ID NO: 1383893 - RNA, 23 nt, Human
gaugggugcccaugcaugugccc

SEQ ID NO: 1383894 - RNA, 19 nt, Human
gcagagccucaaagcggac

SEQ ID NO: 1383895 - RNA, 25 nt, Human
gccuggccucucccaggcuccuucc

SEQ ID NO: 1383896 - RNA, 20 nt, Human
gcuagcaguccggggaggcc

SEQ ID NO: 1383897 - RNA, 24 nt, Human
ggagcaaggggcuggggguagggg

SEQ ID NO: 1383898 - RNA, 19 nt, Human
gugaaacagaagccccaga

SEQ ID NO: 1383899 - RNA, 18 nt, Human
guucaaggccaugccuca

SEQ ID NO: 1383900 - RNA, 20 nt, Human
uagaugccaggggugccccc

SEQ ID NO: 1383901 - RNA, 20 nt, Human
uagcaguccggggaggccug

SEQ ID NO: 1383902 - RNA, 23 nt, Human
uaucauagagccccucuguuggg

SEQ ID NO: 1383903 - RNA, 21 nt, Human
uauccuggagagagcugaaau

SEQ ID NO: 1383904 - RNA, 21 nt, Human
ucaacacacacacauuuccaa

SEQ ID NO: 1383905 - RNA, 21 nt, Human
ucagcuagugccuccccucca

SEQ ID NO: 1383906 - RNA, 21 nt, Human
uccucagguuccuggaagucu

SEQ ID NO: 1383907 - RNA, 22 nt, Human
ucucccaggcuccuuccacugg

SEQ ID NO: 1383908 - RNA, 21 nt, Human
ucugacagggagaaggcauug

SEQ ID NO: 1383909 - RNA, 25 nt, Human
ucugcaggcagcaacauccugguuc

SEQ ID NO: 1383910 - RNA, 21 nt, Human
ucuguccuggcccugcagcac

SEQ ID NO: 1383911 - RNA, 21 nt, Human
ugaaacagaagccccagagac

SEQ ID NO: 1383912 - RNA, 24 nt, Human
ugaaugaagggagcuacuucccuc

SEQ ID NO: 1383913 - RNA, 18 nt, Human
ugccaggggugcccccac

SEQ ID NO: 1383914 - RNA, 19 nt, Human
ugcccagaacacugcagac

SEQ ID NO: 1383915 - RNA, 18 nt, Human
ugccccugguuuaaagcc

SEQ ID NO: 1383916 - RNA, 18 nt, Human
ugccuggagggacaaccu

SEQ ID NO: 1383917 - RNA, 24 nt, Human
uggcuguuaguggcagcuccuccu

SEQ ID NO: 1383918 - RNA, 23 nt, Human
ugguucuuccuccggcuccaggg

SEQ ID NO: 1383919 - RNA, 25 nt, Human
ugucagagacuguucugcacauugu

SEQ ID NO: 1383920 - RNA, 19 nt, Human
aaaaaggccuacugucuuu

SEQ ID NO: 1383921 - RNA, 19 nt, Human
aaaaggauucacccuucua

SEQ ID NO: 1383922 - RNA, 21 nt, Human
aaacaggaugcccuuguccuc

SEQ ID NO: 1383923 - RNA, 18 nt, Human
aaacccgcagcacacucc

SEQ ID NO: 1383924 - RNA, 24 nt, Human
aaacccgcagcacacuccagggug

SEQ ID NO: 1383925 - RNA, 22 nt, Human
aacucgucucucuucuacuuua

SEQ ID NO: 1383926 - RNA, 21 nt, Human
aacucugggcccggacaaccu

SEQ ID NO: 1383927 - RNA, 18 nt, Human
aagaggucaccgcauaug

SEQ ID NO: 1383928 - RNA, 23 nt, Human
aaguggaacagaagccagaaggc

SEQ ID NO: 1383929 - RNA, 21 nt, Human
acaacacaggaaacaggaugc

SEQ ID NO: 1383930 - RNA, 18 nt, Human
accauagaauucucagca

SEQ ID NO: 1383931 - RNA, 23 nt, Human
acuagaaucagaaguggagccug

SEQ ID NO: 1383932 - RNA, 18 nt, Human
acucgucucucuucuacu

SEQ ID NO: 1383933 - RNA, 21 nt, Human
agaacuagaaucagaagugga

SEQ ID NO: 1383934 - RNA, 24 nt, Human
agagaacuagaaucagaaguggag

SEQ ID NO: 1383935 - RNA, 18 nt, Human
agcaagaacgccuccauu

SEQ ID NO: 1383936 - RNA, 21 nt, Human
aggagauuaaaguaucaacau

SEQ ID NO: 1383937 - RNA, 22 nt, Human
aggggccuaggagggccccaga

SEQ ID NO: 1383938 - RNA, 20 nt, Human
aggggucuaagacaucaggg

SEQ ID NO: 1383939 - RNA, 20 nt, Human
agguaggggccuaggagggc

SEQ ID NO: 1383940 - RNA, 21 nt, Human
auggauuugggaaaaguaaag

SEQ ID NO: 1383941 - RNA, 23 nt, Human
caacacaggaaacaggaugcccc

SEQ ID NO: 1383942 - RNA, 19 nt, Human
caagagaacuagaaucaga

SEQ ID NO: 1383943 - RNA, 19 nt, Human
caagagaacuagaaucaga

SEQ ID NO: 1383944 - RNA, 18 nt, Human
caccaggcgcacgcucuc

SEQ ID NO: 1383945 - RNA, 21 nt, Human
cagaaguggagccugacaaug

SEQ ID NO: 1383946 - RNA, 22 nt, Human
cagcacacuccagggugcuuga

SEQ ID NO: 1383947 - RNA, 23 nt, Human
cagcguaguccacuaucucuguu

SEQ ID NO: 1383948 - RNA, 25 nt, Human
caucuucuuccuaaacuggugggga

SEQ ID NO: 1383949 - RNA, 21 nt, Human
ccccagaaaugaagccgaagc

SEQ ID NO: 1383950 - RNA, 24 nt, Human
cuauaguccuucuuacgugucucu

SEQ ID NO: 1383951 - RNA, 20 nt, Human
cuccucuaacugaaaugccc

SEQ ID NO: 1383952 - RNA, 24 nt, Human
cuccucuaccccaucuucuuccua

SEQ ID NO: 1383953 - RNA, 23 nt, Human
cucucaccaggcgcacgcucucc

SEQ ID NO: 1383954 - RNA, 19 nt, Human
cucuguuccauuuucauug

SEQ ID NO: 1383955 - RNA, 18 nt, Human
cucuucuugcaaaaaggc

SEQ ID NO: 1383956 - RNA, 20 nt, Human
gaacagaagccagaaggccc

SEQ ID NO: 1383957 - RNA, 22 nt, Human
gaagccagaaggcccuacagug

SEQ ID NO: 1383958 - RNA, 20 nt, Human
gaccucucccccgcaugccc

SEQ ID NO: 1383959 - RNA, 19 nt, Human
gaggaccaggagccugucc

SEQ ID NO: 1383960 - RNA, 20 nt, Human
gaucuugcucuccuguguca

SEQ ID NO: 1383961 - RNA, 21 nt, Human
gaucuugcucuccugugucac

SEQ ID NO: 1383962 - RNA, 19 nt, Human
ggugcuugaugacaucaag

SEQ ID NO: 1383963 - RNA, 21 nt, Human
gugcuucuauuuacaacacag

SEQ ID NO: 1383964 - RNA, 18 nt, Human
guggaacagaagccagaa

SEQ ID NO: 1383965 - RNA, 18 nt, Human
uaaacugguggggagagc

SEQ ID NO: 1383966 - RNA, 18 nt, Human
uaacagugguaacagacu

SEQ ID NO: 1383967 - RNA, 19 nt, Human
uaagaaacccgcagcacac

SEQ ID NO: 1383968 - RNA, 19 nt, Human
uacaacacaggaaacagga

SEQ ID NO: 1383969 - RNA, 20 nt, Human
uacauuuuauaagacuauag

SEQ ID NO: 1383970 - RNA, 20 nt, Human
uaccccaucuucuuccuaag

SEQ ID NO: 1383971 - RNA, 20 nt, Human
uaggggccuaggagggcccc

SEQ ID NO: 1383972 - RNA, 22 nt, Human
ucaaauuucccagguucucuca

SEQ ID NO: 1383973 - RNA, 22 nt, Human
ucaaguggaacagaagccagaa

SEQ ID NO: 1383974 - RNA, 20 nt, Human
ucaccaggcgcacgcucucc

SEQ ID NO: 1383975 - RNA, 24 nt, Human
ucauacucaggcagguucuguacu

SEQ ID NO: 1383976 - RNA, 22 nt, Human
ucguucucucucaccaggcgca

SEQ ID NO: 1383977 - RNA, 19 nt, Human
ucuccgcccggggcaggag

SEQ ID NO: 1383978 - RNA, 19 nt, Human
ucuccucuaccccaucuuc

SEQ ID NO: 1383979 - RNA, 18 nt, Human
ugaccauagaauucucag

SEQ ID NO: 1383980 - RNA, 20 nt, Human
ugaggggucuaagacaucag

SEQ ID NO: 1383981 - RNA, 24 nt, Human
ugcaaaaaggccuacugucuuuaa

SEQ ID NO: 1383982 - RNA, 18 nt, Human
ugccccguccccuagcuc

SEQ ID NO: 1383983 - RNA, 21 nt, Human
ugccccguccccuagcucccu

SEQ ID NO: 1383984 - RNA, 25 nt, Human
ugccccguccccuagcucccuuuca

SEQ ID NO: 1383985 - RNA, 18 nt, Human
uggaacagaagccagaag

SEQ ID NO: 1383986 - RNA, 30 nt, Human
uggagccugacaaugugacuaaagugcugg

SEQ ID NO: 1383987 - RNA, 21 nt, Human
uggccuaacugucucggaggc

SEQ ID NO: 1383988 - RNA, 21 nt, Human
ugggaaaaguaaagugaaaac

SEQ ID NO: 1383989 - RNA, 18 nt, Human
ugggaggagauuaaagua

SEQ ID NO: 1383990 - RNA, 21 nt, Human
ugggucaaucaacucucucca

SEQ ID NO: 1383991 - RNA, 19 nt, Human
ugggucucuggauuggggc

SEQ ID NO: 1383992 - RNA, 28 nt, Human
ugguggggagagacacacugagaggagg

SEQ ID NO: 1383993 - RNA, 22 nt, Human
uuaauauucuucuggauguuag

SEQ ID NO: 1383994 - RNA, 19 nt, Human
uugcugggucucuggauug

SEQ ID NO: 1383995 - RNA, 23 nt, Human
uugcugggucucuggauuggggc

SEQ ID NO: 1383996 - RNA, 19 nt, Human
aaacagaugagaccuccca

SEQ ID NO: 1383997 - RNA, 22 nt, Human
caaacaggaugcucugguucuu

SEQ ID NO: 1383998 - RNA, 24 nt, Human
cacaagcaaguaacuggagaagca

SEQ ID NO: 1383999 - RNA, 26 nt, Human
cccaaacagaugagaccucccaacuu

SEQ ID NO: 1384000 - RNA, 22 nt, Human
gacaucuuuggccacuucuugc

SEQ ID NO: 1384001 - RNA, 22 nt, Human
gcgguucuagugacuauagccu

SEQ ID NO: 1384002 - RNA, 18 nt, Human
ggaaaacaaccuuucuca

SEQ ID NO: 1384003 - RNA, 22 nt, Human
guccgaacuguccuuaguaggg

SEQ ID NO: 1384004 - RNA, 23 nt, Human
uacccuguucauuugaaagcuua

SEQ ID NO: 1384005 - RNA, 18 nt, Human
uagaugcaacuuuacccu

SEQ ID NO: 1384006 - RNA, 19 nt, Human
uagcuaggcauccuaaagc

SEQ ID NO: 1384007 - RNA, 22 nt, Human
uagugacuauagccuuagguga

SEQ ID NO: 1384008 - RNA, 23 nt, Human
ucugaagugacaucuuuggccac

SEQ ID NO: 1384009 - RNA, 18 nt, Human
ucuuuggccacuucuugc

SEQ ID NO: 1384010 - RNA, 20 nt, Human
ugagaccucccaacuugaaa

SEQ ID NO: 1384011 - RNA, 21 nt, Human
uggagaagcaggccagagugc

SEQ ID NO: 1384012 - RNA, 23 nt, Human
ugguucuuguccauuuuccuagc

SEQ ID NO: 1384013 - RNA, 22 nt, Human
uguagcuaggcauccuaaagcc

SEQ ID NO: 1384014 - RNA, 19 nt, Human
uuccguguuugauguagcu

SEQ ID NO: 1384015 - RNA, 21 nt, Human
uucuugcuuugcuaaaaauug

SEQ ID NO: 1384016 - RNA, 23 nt, Human
uugaaaggaucccugcaccacaa

SEQ ID NO: 1384017 - RNA, 21 nt, Human
aaaccccagcccucagguacc

SEQ ID NO: 1384018 - RNA, 19 nt, Human
aaagggaucaggugcucug

SEQ ID NO: 1384019 - RNA, 19 nt, Human
aaaugacacuuccccuccc

SEQ ID NO: 1384020 - RNA, 19 nt, Human
aagacacgcacugacgaca

SEQ ID NO: 1384021 - RNA, 24 nt, Human
aaggagcggagccgagacccugcc

SEQ ID NO: 1384022 - RNA, 22 nt, Human
aaggaggcaucacacaaggaaa

SEQ ID NO: 1384023 - RNA, 19 nt, Human
acagcagaagggccaacgg

SEQ ID NO: 1384024 - RNA, 21 nt, Human
acagcagaagggccaacggga

SEQ ID NO: 1384025 - RNA, 21 nt, Human
accacagggugcaccagcccg

SEQ ID NO: 1384026 - RNA, 28 nt, Human
agacccagcgaggccaccggagccagga

SEQ ID NO: 1384027 - RNA, 23 nt, Human
agaccggcagccucgacgaagaa

SEQ ID NO: 1384028 - RNA, 20 nt, Human
agaguaaguggaaggguggg

SEQ ID NO: 1384029 - RNA, 20 nt, Human
agcaugggcccuggcaccug

SEQ ID NO: 1384030 - RNA, 20 nt, Human
aggaguuuugggcccagagc

SEQ ID NO: 1384031 - RNA, 20 nt, Human
aggcaggaguuuugggccca

SEQ ID NO: 1384032 - RNA, 21 nt, Human
aggcaggaguuuugggcccag

SEQ ID NO: 1384033 - RNA, 23 nt, Human
aggcaggaguuuugggcccagag

SEQ ID NO: 1384034 - RNA, 25 nt, Human
aggccaaggccaggggaccucgaga

SEQ ID NO: 1384035 - RNA, 24 nt, Human
agggugcaccagcccgcagggcag

SEQ ID NO: 1384036 - RNA, 21 nt, Human
agguguuagcggucuauaacu

SEQ ID NO: 1384037 - RNA, 21 nt, Human
augggcccuggcaccugucag

SEQ ID NO: 1384038 - RNA, 28 nt, Human
augggcccuggcaccugucccgucaacg

SEQ ID NO: 1384039 - RNA, 22 nt, Human
caaaauuagcagcaaugcugag

SEQ ID NO: 1384040 - RNA, 25 nt, Human
caaaguacuugagacauugccugug

SEQ ID NO: 1384041 - RNA, 23 nt, Human
caaccaggccaaggccaggggac

SEQ ID NO: 1384042 - RNA, 23 nt, Human
cacauccagggaaaccccagccc

SEQ ID NO: 1384043 - RNA, 23 nt, Human
caccugucagccccggcaggucu

SEQ ID NO: 1384044 - RNA, 22 nt, Human
cacguacucagccaugcauaua

SEQ ID NO: 1384045 - RNA, 21 nt, Human
cacuuccccucccauugucac

SEQ ID NO: 1384046 - RNA, 19 nt, Human
cagaaaaucauuucaccau

SEQ ID NO: 1384047 - RNA, 19 nt, Human
cagaaacuagcaggaccaa

SEQ ID NO: 1384048 - RNA, 22 nt, Human
cagcagaagggccaacgggagg

SEQ ID NO: 1384049 - RNA, 22 nt, Human
caggagcccacacuugucacac

SEQ ID NO: 1384050 - RNA, 20 nt, Human
caggccacagagcugugcac

SEQ ID NO: 1384051 - RNA, 21 nt, Human
cagggaaaccccagcccucaa

SEQ ID NO: 1384052 - RNA, 23 nt, Human
caggucucacggccuccggaacc

SEQ ID NO: 1384053 - RNA, 22 nt, Human
cauauagacagcaaacauuaug

SEQ ID NO: 1384054 - RNA, 25 nt, Human
ccacagagcugugcaccgcccggcc

SEQ ID NO: 1384055 - RNA, 21 nt, Human
ccacaggccacagagcugugc

SEQ ID NO: 1384056 - RNA, 20 nt, Human
ccagaaacuagcaggaccaa

SEQ ID NO: 1384057 - RNA, 22 nt, Human
cccacauccagggaaaccccag

SEQ ID NO: 1384058 - RNA, 21 nt, Human
cccgcacgaguucccagcccc

SEQ ID NO: 1384059 - RNA, 23 nt, Human
ccuaaggucaaaguacuugagac

SEQ ID NO: 1384060 - RNA, 21 nt, Human
ccuccuuuccuagguaugggc

SEQ ID NO: 1384061 - RNA, 22 nt, Human
ccuggcaccugucagccccggc

SEQ ID NO: 1384062 - RNA, 20 nt, Human
ccugucagccccggcagguc

SEQ ID NO: 1384063 - RNA, 19 nt, Human
cgaggacaccaggcaggag

SEQ ID NO: 1384064 - RNA, 19 nt, Human
cgcacgucgcggguacacg

SEQ ID NO: 1384065 - RNA, 24 nt, Human
cgccucggucgcgccccgcacgag

SEQ ID NO: 1384066 - RNA, 19 nt, Human
cggagccgagacccugccg

SEQ ID NO: 1384067 - RNA, 23 nt, Human
cggccuccggaaccauggacccu

SEQ ID NO: 1384068 - RNA, 22 nt, Human
cguccgcaagaaggcugagcac

SEQ ID NO: 1384069 - RNA, 22 nt, Human
cucacagcagaagggccaacgg

SEQ ID NO: 1384070 - RNA, 20 nt, Human
cucuaaaucccauuguccuc

SEQ ID NO: 1384071 - RNA, 23 nt, Human
cugugagaagagggagcgccugg

SEQ ID NO: 1384072 - RNA, 20 nt, Human
cuucuacccuaaggucaaag

SEQ ID NO: 1384073 - RNA, 23 nt, Human
cuugcagccaagcaugcuccauu

SEQ ID NO: 1384074 - RNA, 22 nt, Human
gaaaccccagcccucagguacc

SEQ ID NO: 1384075 - RNA, 20 nt, Human
gaagaguaaguggaagggug

SEQ ID NO: 1384076 - RNA, 19 nt, Human
gaccacagggugcaccagc

SEQ ID NO: 1384077 - RNA, 19 nt, Human
gagacauuuacuggcagcu

SEQ ID NO: 1384078 - RNA, 19 nt, Human
gaggcaucacacaaggaaa

SEQ ID NO: 1384079 - RNA, 19 nt, Human
gaggccaccggagccagga

SEQ ID NO: 1384080 - RNA, 18 nt, Human
gagguggggccgcugugu

SEQ ID NO: 1384081 - RNA, 24 nt, Human
gcacacaggcucccgcagcauggg

SEQ ID NO: 1384082 - RNA, 23 nt, Human
gccacaggccacagagcugugca

SEQ ID NO: 1384083 - RNA, 23 nt, Human
gccccgcacgaguucccagcccc

SEQ ID NO: 1384084 - RNA, 22 nt, Human
gccgacuccggcuuuucgccac

SEQ ID NO: 1384085 - RNA, 22 nt, Human
gccgagacccugccgacagcag

SEQ ID NO: 1384086 - RNA, 21 nt, Human
gccgcugugagaagagggagc

SEQ ID NO: 1384087 - RNA, 21 nt, Human
gcuaacuccgggaaaccagug

SEQ ID NO: 1384088 - RNA, 24 nt, Human
gcuuagaaggagcggagccgagac

SEQ ID NO: 1384089 - RNA, 19 nt, Human
ggaaugaacaguccucugc

SEQ ID NO: 1384090 - RNA, 22 nt, Human
ggacgaggacaccaggcaggag

SEQ ID NO: 1384091 - RNA, 18 nt, Human
ggacugagguggggccgc

SEQ ID NO: 1384092 - RNA, 21 nt, Human
ggagacgcuauucucuuuacc

SEQ ID NO: 1384093 - RNA, 30 nt, Human
ggagccgagacccugccgacagcaggggaa

SEQ ID NO: 1384094 - RNA, 21 nt, Human
ggaggaagaguaaguggaagg

SEQ ID NO: 1384095 - RNA, 20 nt, Human
ggcagcuuugccuucuaccc

SEQ ID NO: 1384096 - RNA, 24 nt, Human
gggcauugcaaaguuuccccaaug

SEQ ID NO: 1384097 - RNA, 21 nt, Human
gggccaacgggaggcagggaa

SEQ ID NO: 1384098 - RNA, 24 nt, Human
gugugccuaaggaggcaucacaca

SEQ ID NO: 1384099 - RNA, 22 nt, Human
guguguggagcaguacacgggc

SEQ ID NO: 1384100 - RNA, 19 nt, Human
uaaggaggcaucacacaag

SEQ ID NO: 1384101 - RNA, 22 nt, Human
uaaguggaagggugggacgagg

SEQ ID NO: 1384102 - RNA, 20 nt, Human
uacagcucccgucaucccuu

SEQ ID NO: 1384103 - RNA, 21 nt, Human
uagaaggagcggagccgagac

SEQ ID NO: 1384104 - RNA, 24 nt, Human
uagacagcaaacauuaugaaucuc

SEQ ID NO: 1384105 - RNA, 19 nt, Human
uaugcacaccacgcacgua

SEQ ID NO: 1384106 - RNA, 23 nt, Human
ucacaguuugguucugcuaauca

SEQ ID NO: 1384107 - RNA, 23 nt, Human
uccaggcgagcucacagcagaag

SEQ ID NO: 1384108 - RNA, 21 nt, Human
ucccagccccacauccaggga

SEQ ID NO: 1384109 - RNA, 23 nt, Human
ucccagccccacauccagggaaa

SEQ ID NO: 1384110 - RNA, 22 nt, Human
uccccgagacccagcgaggcca

SEQ ID NO: 1384111 - RNA, 21 nt, Human
uccgcaagaaggcugagcaca

SEQ ID NO: 1384112 - RNA, 22 nt, Human
ucuacaacacauuuauuuguac

SEQ ID NO: 1384113 - RNA, 19 nt, Human
ucuucggggcauugcaaag

SEQ ID NO: 1384114 - RNA, 21 nt, Human
ucuucggggcauugcaaaguu

SEQ ID NO: 1384115 - RNA, 23 nt, Human
ugacgacaucacgcacguacgca

SEQ ID NO: 1384116 - RNA, 21 nt, Human
uggcaccugucagccccggca

SEQ ID NO: 1384117 - RNA, 19 nt, Human
uggcuaguguccaggcugc

SEQ ID NO: 1384118 - RNA, 23 nt, Human
ugggcccuggcaccugucagccc

SEQ ID NO: 1384119 - RNA, 26 nt, Human
ugggcgcgcaaucacgcauguaugca

SEQ ID NO: 1384120 - RNA, 21 nt, Human
ugggguuugaaaucacaguca

SEQ ID NO: 1384121 - RNA, 24 nt, Human
ugggugucuagggccgacuccggc

SEQ ID NO: 1384122 - RNA, 21 nt, Human
ugguucugcuaaucacagcag

SEQ ID NO: 1384123 - RNA, 26 nt, Human
uguaugcacaccacgcacguacgcgg

SEQ ID NO: 1384124 - RNA, 20 nt, Human
ugucacggggcgaguguuug

SEQ ID NO: 1384125 - RNA, 19 nt, Human
ugugcaccgcccggccuca

SEQ ID NO: 1384126 - RNA, 24 nt, Human
uguguguggagcaguacacgggcu

SEQ ID NO: 1384127 - RNA, 24 nt, Human
uguuugggacucuaaaucccauug

SEQ ID NO: 1384128 - RNA, 21 nt, Human
uuagcggucuauaacucuucc

SEQ ID NO: 1384129 - RNA, 18 nt, Human
uuuacuggcagcuuugcc

SEQ ID NO: 1384130 - RNA, 23 nt, Human
uuuucuaguuccacaaccucauc

SEQ ID NO: 1384131 - RNA, 20 nt, Human
aaggaccucacagggguaug

SEQ ID NO: 1384132 - RNA, 21 nt, Human
aaggcaccugcaacccagaac

SEQ ID NO: 1384133 - RNA, 24 nt, Human
acccagaacgcagcagcucaggcc

SEQ ID NO: 1384134 - RNA, 24 nt, Human
accuaagucagagcacugcccagu

SEQ ID NO: 1384135 - RNA, 21 nt, Human
agagcacugcccagugaagcc

SEQ ID NO: 1384136 - RNA, 19 nt, Human
aggaacgcccccgcgcccc

SEQ ID NO: 1384137 - RNA, 21 nt, Human
aggaacgcccccgcgccccgc

SEQ ID NO: 1384138 - RNA, 20 nt, Human
caacccagaacgcagcagcu

SEQ ID NO: 1384139 - RNA, 23 nt, Human
caacccagaacgcagcagcucag

SEQ ID NO: 1384140 - RNA, 18 nt, Human
caaucuuccuccugcccc

SEQ ID NO: 1384141 - RNA, 22 nt, Human
caccacccagucagcacaaauc

SEQ ID NO: 1384142 - RNA, 22 nt, Human
cacugcccagugaagccaccac

SEQ ID NO: 1384143 - RNA, 19 nt, Human
cagcagcucaggccagcug

SEQ ID NO: 1384144 - RNA, 24 nt, Human
ccaaccuaagucagagcacugccc

SEQ ID NO: 1384145 - RNA, 19 nt, Human
ccccgcgccggcggagccu

SEQ ID NO: 1384146 - RNA, 23 nt, Human
cccgccccugcaaucuuccuccu

SEQ ID NO: 1384147 - RNA, 18 nt, Human
ccugcaacccagaacgca

SEQ ID NO: 1384148 - RNA, 24 nt, Human
ccugcaacccagaacgcagcagcu

SEQ ID NO: 1384149 - RNA, 22 nt, Human
ccugcaaucuuccuccugcccc

SEQ ID NO: 1384150 - RNA, 20 nt, Human
cgcagcagcucaggccagcu

SEQ ID NO: 1384151 - RNA, 19 nt, Human
cuaggaacgcccccgcgcc

SEQ ID NO: 1384152 - RNA, 19 nt, Human
gaauucccgggagaguucc

SEQ ID NO: 1384153 - RNA, 22 nt, Human
gcaacccagaacgcagcagcuc

SEQ ID NO: 1384154 - RNA, 22 nt, Human
gccccgggcagggccuuagggg

SEQ ID NO: 1384155 - RNA, 20 nt, Human
ggcagggccuuaggggccgg

SEQ ID NO: 1384156 - RNA, 18 nt, Human
gucagagcacugcccagu

SEQ ID NO: 1384157 - RNA, 26 nt, Human
ucaaaacacuacuguccaugugcuga

SEQ ID NO: 1384158 - RNA, 21 nt, Human
ucagcacaaaucaaaacacua

SEQ ID NO: 1384159 - RNA, 26 nt, Human
uccuccugccccgggcagggccuuag

SEQ ID NO: 1384160 - RNA, 20 nt, Human
ucuucccgccccugcaaucu

SEQ ID NO: 1384161 - RNA, 21 nt, Human
ugaaaggaccucacaggggua

SEQ ID NO: 1384162 - RNA, 24 nt, Human
ugccccgggcagggccuuaggggc

SEQ ID NO: 1384163 - RNA, 19 nt, Human
aaaacaaaauaagacaaaa

SEQ ID NO: 1384164 - RNA, 18 nt, Human
aaacaaaaaaagcaaaca

SEQ ID NO: 1384165 - RNA, 26 nt, Human
aaacaaaaaaagcaaacaugcccugg

SEQ ID NO: 1384166 - RNA, 21 nt, Human
aaacaaaacaaaauaagacaa

SEQ ID NO: 1384167 - RNA, 26 nt, Human
aaacaaacacauaaacaaaaaaagca

SEQ ID NO: 1384168 - RNA, 19 nt, Human
aaacaagcauaaaaaucac

SEQ ID NO: 1384169 - RNA, 24 nt, Human
aaacaagcauaaaaaucacaaaaa

SEQ ID NO: 1384170 - RNA, 23 nt, Human
aacaaauguggaguaggccacaa

SEQ ID NO: 1384171 - RNA, 23 nt, Human
aacacauaaacaaaaaaagcaaa

SEQ ID NO: 1384172 - RNA, 22 nt, Human
aacugagaacuauuuuaaauau

SEQ ID NO: 1384173 - RNA, 18 nt, Human
aagaacuuucaguucaau

SEQ ID NO: 1384174 - RNA, 24 nt, Human
aagucaguucuagaucaucaccau

SEQ ID NO: 1384175 - RNA, 18 nt, Human
aaguucuaggaauucuuc

SEQ ID NO: 1384176 - RNA, 21 nt, Human
aaucacaugagaaacauuuaa

SEQ ID NO: 1384177 - RNA, 27 nt, Human
aaucacgugaacccaggaggcggagcu

SEQ ID NO: 1384178 - RNA, 21 nt, Human
aauggaauacaggaggaacug

SEQ ID NO: 1384179 - RNA, 21 nt, Human
acaaaacaaaauaagacaaaa

SEQ ID NO: 1384180 - RNA, 25 nt, Human
acaaacacauaaacaaaaaaagcaa

SEQ ID NO: 1384181 - RNA, 24 nt, Human
acaguguaagagagaauacaacuu

SEQ ID NO: 1384182 - RNA, 24 nt, Human
acagugugagacucugucucaaaa

SEQ ID NO: 1384183 - RNA, 22 nt, Human
acauaaaucccaacauauucca

SEQ ID NO: 1384184 - RNA, 18 nt, Human
accauguuggccaggcug

SEQ ID NO: 1384185 - RNA, 19 nt, Human
acgccggagcccacgggga

SEQ ID NO: 1384186 - RNA, 18 nt, Human
acgguguuucaccauguu

SEQ ID NO: 1384187 - RNA, 24 nt, Human
acgguguuucaccauguuggccag

SEQ ID NO: 1384188 - RNA, 18 nt, Human
agagagcaacugaaacau

SEQ ID NO: 1384189 - RNA, 23 nt, Human
agcaaaaggggcaggaggaagaa

SEQ ID NO: 1384190 - RNA, 20 nt, Human
agcaggaaaaaaaugcauaa

SEQ ID NO: 1384191 - RNA, 22 nt, Human
agccaauccgcggucccggcgc

SEQ ID NO: 1384192 - RNA, 23 nt, Human
agccgggcgugauggugcacgcc

SEQ ID NO: 1384193 - RNA, 24 nt, Human
agccugggccacagugugagacuc

SEQ ID NO: 1384194 - RNA, 20 nt, Human
agcgauucuccugccucagc

SEQ ID NO: 1384195 - RNA, 25 nt, Human
agcuggacucaccaguuucaaccug

SEQ ID NO: 1384196 - RNA, 20 nt, Human
aggaaaaugugaaaucccau

SEQ ID NO: 1384197 - RNA, 19 nt, Human
aggaggaagaagguacaga

SEQ ID NO: 1384198 - RNA, 19 nt, Human
aggaggaagaagguacaga

SEQ ID NO: 1384199 - RNA, 23 nt, Human
aggaugaaaguuggaauugcaaa

SEQ ID NO: 1384200 - RNA, 22 nt, Human
aggccgagaccccaggagcaaa

SEQ ID NO: 1384201 - RNA, 22 nt, Human
aggcuggucucuacugaaaaua

SEQ ID NO: 1384202 - RNA, 20 nt, Human
aguacaguggugcaaucuug

SEQ ID NO: 1384203 - RNA, 24 nt, Human
aguacaguggugcaaucuuggcuc

SEQ ID NO: 1384204 - RNA, 18 nt, Human
aguggcugggaauacagg

SEQ ID NO: 1384205 - RNA, 25 nt, Human
auaaauccuuccccaguuucuuuaa

SEQ ID NO: 1384206 - RNA, 26 nt, Human
auaaauccuuccccaguuucuuuaaa

SEQ ID NO: 1384207 - RNA, 22 nt, Human
aucauagcauuuuccagcaauu

SEQ ID NO: 1384208 - RNA, 21 nt, Human
auguaagaacuuucaguucaa

SEQ ID NO: 1384209 - RNA, 25 nt, Human
caaaaaaagcaaacaugcccuggug

SEQ ID NO: 1384210 - RNA, 20 nt, Human
caaaaaacaaacacauaaac

SEQ ID NO: 1384211 - RNA, 24 nt, Human
caaaaaacaaacacauaaacaaaa

SEQ ID NO: 1384212 - RNA, 25 nt, Human
caaaacucacuaggaaccaaucucc

SEQ ID NO: 1384213 - RNA, 19 nt, Human
caaaauaagacaaaacuug

SEQ ID NO: 1384214 - RNA, 22 nt, Human
caaccuccacaucccagguucc

SEQ ID NO: 1384215 - RNA, 21 nt, Human
caaccuucucacccgcgggcc

SEQ ID NO: 1384216 - RNA, 24 nt, Human
cacagugugagacucugucucaaa

SEQ ID NO: 1384217 - RNA, 22 nt, Human
cacauaaacaaaaaaagcaaac

SEQ ID NO: 1384218 - RNA, 19 nt, Human
caccaccacaccuaauuuu

SEQ ID NO: 1384219 - RNA, 21 nt, Human
caccauguuggccaggcuggu

SEQ ID NO: 1384220 - RNA, 24 nt, Human
caccauguuggccaggcuggucuc

SEQ ID NO: 1384221 - RNA, 30 nt, Human; identical to SEQ ID NO: 575876

SEQ ID NO: 1384222 - RNA, 23 nt, Human
cacgccugugaucccagcuacuu

SEQ ID NO: 1384223 - RNA, 24 nt, Human
cacgccugugaucccagcuacuug

SEQ ID NO: 1384224 - RNA, 25 nt, Human
cacugugcuggaguccagccugggc

SEQ ID NO: 1384225 - RNA, 18 nt, Human
cagaggcaaacauaaauc

SEQ ID NO: 1384226 - RNA, 19 nt, Human
cagcaggaaaaaaaugcau

SEQ ID NO: 1384227 - RNA, 22 nt, Human
cagccggccaaggccgagaccc

SEQ ID NO: 1384228 - RNA, 30 nt, Human; identical to SEQ ID NO: 575885

SEQ ID NO: 1384229 - RNA, 20 nt, Human
cagccuccugaguggcuggg

SEQ ID NO: 1384230 - RNA, 20 nt, Human
cauauuaaauugaagauaau

SEQ ID NO: 1384231 - RNA, 24 nt, Human
caucccagguuccagcgauucucc

SEQ ID NO: 1384232 - RNA, 28 nt, Human
cauguuggccaggcuggucucuacugaa

SEQ ID NO: 1384233 - RNA, 18 nt, Human
cauugcucaagacuucca

SEQ ID NO: 1384234 - RNA, 22 nt, Human
ccaaggccgagaccccaggagc

SEQ ID NO: 1384235 - RNA, 21 nt, Human
ccacccaccucccgucgcaac

SEQ ID NO: 1384236 - RNA, 27 nt, Human
ccagcgauucuccugccucagccuccu

SEQ ID NO: 1384237 - RNA, 26 nt, Human
cccaacauauuccaccgaccaaacaa

SEQ ID NO: 1384238 - RNA, 22 nt, Human
ccccaggagcaaagcccgcgcc

SEQ ID NO: 1384239 - RNA, 22 nt, Human
cccgacagcugcgcaagccgcc

SEQ ID NO: 1384240 - RNA, 22 nt, Human
cccucuguugcccaggcuggag

SEQ ID NO: 1384241 - RNA, 21 nt, Human
ccggccaaggccgagacccca

SEQ ID NO: 1384242 - RNA, 22 nt, Human
ccucccgucgcaaccuucucac

SEQ ID NO: 1384243 - RNA, 23 nt, Human
ccucccgucgcaaccuucucacc

SEQ ID NO: 1384244 - RNA, 18 nt, Human
ccugugaucccagcuacu

SEQ ID NO: 1384245 - RNA, 21 nt, Human
ccugugaucccagcuacuugg

SEQ ID NO: 1384246 - RNA, 22 nt, Human
ccugugaucccagcuacuuggg

SEQ ID NO: 1384247 - RNA, 19 nt, Human
cgaccaaacaagcauaaaa

SEQ ID NO: 1384248 - RNA, 22 nt, Human
cgaggcagccaauccgcggucc

SEQ ID NO: 1384249 - RNA, 24 nt, Human
cgcccgacgcggcugaacgcaguc

SEQ ID NO: 1384250 - RNA, 24 nt, Human
cgccugugaucccagcuacuuggg

SEQ ID NO: 1384251 - RNA, 23 nt, Human
cggccaaggccgagaccccagga

SEQ ID NO: 1384252 - RNA, 28 nt, Human
cuaauuuuuuguauuuuuaguagagacg

SEQ ID NO: 1384253 - RNA, 24 nt, Human
cuagaaaacacauuccacauauua

SEQ ID NO: 1384254 - RNA, 22 nt, Human
cuagauggagucucccucuguu

SEQ ID NO: 1384255 - RNA, 21 nt, Human
cuagggcacccgaacuugggc

SEQ ID NO: 1384256 - RNA, 18 nt, Human
cucaagacuuccauucag

SEQ ID NO: 1384257 - RNA, 21 nt, Human
cucacuaggaaccaaucucca

SEQ ID NO: 1384258 - RNA, 24 nt, Human
cucacugcaaccuccacaucccag

SEQ ID NO: 1384259 - RNA, 20 nt, Human
cucccgucgcaaccuucuca

SEQ ID NO: 1384260 - RNA, 24 nt, Human
cucccucuguugcccaggcuggag

SEQ ID NO: 1384261 - RNA, 23 nt, Human
cucuguugcccaggcuggaguac

SEQ ID NO: 1384262 - RNA, 20 nt, Human
cugcaaccuccacaucccaa

SEQ ID NO: 1384263 - RNA, 23 nt, Human
cugccucagccuccugaguggcu

SEQ ID NO: 1384264 - RNA, 20 nt, Human
cugguuuaaacaaacaaaac

SEQ ID NO: 1384265 - RNA, 24 nt, Human
gaacaaacauagcagaauugccuu

SEQ ID NO: 1384266 - RNA, 22 nt, Human
gaacaaauguggaguaggccac

SEQ ID NO: 1384267 - RNA, 27 nt, Human
gaccaaacaagcauaaaaaucacaaaa

SEQ ID NO: 1384268 - RNA, 23 nt, Human
gagcugagaucaugccacugugc

SEQ ID NO: 1384269 - RNA, 22 nt, Human
gagggccggucgccggcugccg

SEQ ID NO: 1384270 - RNA, 18 nt, Human
gauauaagauaaaauucu

SEQ ID NO: 1384271 - RNA, 24 nt, Human
gauggugcacgccugugaucccag

SEQ ID NO: 1384272 - RNA, 21 nt, Human
gauucuccugccucagccucc

SEQ ID NO: 1384273 - RNA, 21 nt, Human
gcaaaagcagagcgcaacccg

SEQ ID NO: 1384274 - RNA, 22 nt, Human
gcaaccuccacaucccagguuc

SEQ ID NO: 1384275 - RNA, 24 nt, Human
gccaccaauaaagaauucuaagca

SEQ ID NO: 1384276 - RNA, 20 nt, Human
gccucagccuccugaguggc

SEQ ID NO: 1384277 - RNA, 24 nt, Human
gccucagccuccugaguggcuggg

SEQ ID NO: 1384278 - RNA, 24 nt, Human
gcgauucuccugccucagccuccu

SEQ ID NO: 1384279 - RNA, 26 nt, Human
gcuaaaccagguugccauacauaauu

SEQ ID NO: 1384280 - RNA, 23 nt, Human
gcuagggcacccgaacuugggca

SEQ ID NO: 1384281 - RNA, 30 nt, Human; identical to SEQ ID NO: 575937

SEQ ID NO: 1384282 - RNA, 22 nt, Human
ggagcaaagcccgcgccucccg

SEQ ID NO: 1384283 - RNA, 23 nt, Human
ggagucucccucuguugcccagg

SEQ ID NO: 1384284 - RNA, 24 nt, Human
gggcgugauggugcacgccuguga

SEQ ID NO: 1384285 - RNA, 19 nt, Human
ggggcaggaggaagaaggu

SEQ ID NO: 1384286 - RNA, 23 nt, Human
gguaauaauagaaaaaucauagc

SEQ ID NO: 1384287 - RNA, 18 nt, Human
gguccagccggccaaggc

SEQ ID NO: 1384288 - RNA, 23 nt, Human
gguguuucaccauguuggccagg

SEQ ID NO: 1384289 - RNA, 23 nt, Human
guaaaauacucuguacccuguca

SEQ ID NO: 1384290 - RNA, 21 nt, Human
guauacccaaaguuuaaccca

SEQ ID NO: 1384291 - RNA, 20 nt, Human
gugaagaacaaacauagcag

SEQ ID NO: 1384292 - RNA, 20 nt, Human
gugugagacucugucucaaa

SEQ ID NO: 1384293 - RNA, 18 nt, Human
uaaaaaagcaaaaggggc

SEQ ID NO: 1384294 - RNA, 26 nt, Human
uaaaauacucuguacccugucaaaac

SEQ ID NO: 1384295 - RNA, 23 nt, Human
uaaaauagauacaacauuugggc

SEQ ID NO: 1384296 - RNA, 24 nt, Human
uaaaauagauacaacauuugggca

SEQ ID NO: 1384297 - RNA, 21 nt, Human
uaacccaauuguugcaacccc

SEQ ID NO: 1384298 - RNA, 24 nt, Human
uaacccugaggaaggaagaacaaa

SEQ ID NO: 1384299 - RNA, 24 nt, Human
uaauaauagaaaaaucauagcauu

SEQ ID NO: 1384300 - RNA, 25 nt, Human
uaauuuuuuguauuuuuaguagagg

SEQ ID NO: 1384301 - RNA, 22 nt, Human
uacagaaaucacaugagaaaca

SEQ ID NO: 1384302 - RNA, 19 nt, Human
uacaguggugcaaucuugg

SEQ ID NO: 1384303 - RNA, 22 nt, Human
uacaguggugcaaucuuggcuc

SEQ ID NO: 1384304 - RNA, 21 nt, Human
uacccugucaaaacuccuuug

SEQ ID NO: 1384305 - RNA, 18 nt, Human
uagaaaacacauuccaca

SEQ ID NO: 1384306 - RNA, 22 nt, Human
uagagacgguguuucaccaugu

SEQ ID NO: 1384307 - RNA, 24 nt, Human
uaguagagacgguguuucaccaug

SEQ ID NO: 1384308 - RNA, 20 nt, Human
ucaaccuguggaaaugaaau

SEQ ID NO: 1384309 - RNA, 22 nt, Human
ucacuagaaagacgcuagcuau

SEQ ID NO: 1384310 - RNA, 21 nt, Human
ucacugcaaccuccacauccc

SEQ ID NO: 1384311 - RNA, 24 nt, Human
ucacugcaaccuccacaucccagg

SEQ ID NO: 1384312 - RNA, 20 nt, Human
ucagccuccugaguggcugg

SEQ ID NO: 1384313 - RNA, 21 nt, Human
uccacauauuaaauugaagau

SEQ ID NO: 1384314 - RNA, 23 nt, Human
uccacaucccagguuccagcgau

SEQ ID NO: 1384315 - RNA, 21 nt, Human
ucccagguuccagcgauucuc

SEQ ID NO: 1384316 - RNA, 24 nt, Human
ucccagguuccagcgauucuccug

SEQ ID NO: 1384317 - RNA, 22 nt, Human
uccccaguuucuuuaaaaaagc

SEQ ID NO: 1384318 - RNA, 22 nt, Human
ucccggcgcuggcgaguuccac

SEQ ID NO: 1384319 - RNA, 20 nt, Human
ucccucuguugcccaggcug

SEQ ID NO: 1384320 - RNA, 24 nt, Human
ucccucuguugcccaggcuggagu

SEQ ID NO: 1384321 - RNA, 23 nt, Human
ucucccucuguugcccaggcugg

SEQ ID NO: 1384322 - RNA, 24 nt, Human
ucucccucuguugcccaggcugga

SEQ ID NO: 1384323 - RNA, 24 nt, Human
ucuccugccucagccuccugagug

SEQ ID NO: 1384324 - RNA, 23 nt, Human
ucucuacugaaaauacaaaaauu

SEQ ID NO: 1384325 - RNA, 18 nt, Human
ucuguugcccaggcugga

SEQ ID NO: 1384326 - RNA, 20 nt, Human
ugaagaacaaacauagcaga

SEQ ID NO: 1384327 - RNA, 23 nt, Human
ugaaguaagucaguucuagauca

SEQ ID NO: 1384328 - RNA, 24 nt, Human
ugagauggagucuagauggagucu

SEQ ID NO: 1384329 - RNA, 20 nt, Human
ugaggcaugagaaucacgug

SEQ ID NO: 1384330 - RNA, 24 nt, Human
ugaggcaugagaaucacgugaacc

SEQ ID NO: 1384331 - RNA, 24 nt, Human
ugauggugcacgccugugauccca

SEQ ID NO: 1384332 - RNA, 18 nt, Human
ugccauacauaauucaaa

SEQ ID NO: 1384333 - RNA, 21 nt, Human
ugccauuacaguuauuauucu

SEQ ID NO: 1384334 - RNA, 21 nt, Human
ugcccaggcuggaguacagug

SEQ ID NO: 1384335 - RNA, 24 nt, Human
ugcccaggcuggaguacaguggug

SEQ ID NO: 1384336 - RNA, 20 nt, Human
ugcccuggugcuuccaaugu

SEQ ID NO: 1384337 - RNA, 24 nt, Human
ugccucagccuccugaguggcugg

SEQ ID NO: 1384338 - RNA, 23 nt, Human
ugccuuaguugaggcuacagugu

SEQ ID NO: 1384339 - RNA, 20 nt, Human
ugcuggaguccagccugggc

SEQ ID NO: 1384340 - RNA, 22 nt, Human
ugcuuccaauguauacccaaag

SEQ ID NO: 1384341 - RNA, 24 nt, Human
uggaguacaguggugcaaucuugg

SEQ ID NO: 1384342 - RNA, 19 nt, Human
uggagucuagauggagucu

SEQ ID NO: 1384343 - RNA, 24 nt, Human
uggagucucccucuguugcccagg

SEQ ID NO: 1384344 - RNA, 20 nt, Human
uggccaggcuggucucuacu

SEQ ID NO: 1384345 - RNA, 22 nt, Human
uggcgaguuccacccaccuccc

SEQ ID NO: 1384346 - RNA, 24 nt, Human
ugggaauacaggcacgcaccacca

SEQ ID NO: 1384347 - RNA, 24 nt, Human
ugggaggcugaggcaugagaauca

SEQ ID NO: 1384348 - RNA, 21 nt, Human
uggugcacgccugugauccca

SEQ ID NO: 1384349 - RNA, 24 nt, Human
ugguuuaaacaaacaaaacaaaau

SEQ ID NO: 1384350 - RNA, 22 nt, Human
uguaagagagaauacaacuuag

SEQ ID NO: 1384351 - RNA, 19 nt, Human
ugucucaaaaaacaaacac

SEQ ID NO: 1384352 - RNA, 18 nt, Human
ugugaaaucccaucucaa

SEQ ID NO: 1384353 - RNA, 21 nt, Human
uuaaaaauacuuuuaguaaaa

SEQ ID NO: 1384354 - RNA, 22 nt, Human
uuaacccaauuguugcaacccc

SEQ ID NO: 1384355 - RNA, 20 nt, Human
uuagccgggcgugauggugc

SEQ ID NO: 1384356 - RNA, 24 nt, Human
uuagccgggcgugauggugcacgc

SEQ ID NO: 1384357 - RNA, 24 nt, Human
uuaguagagacgguguuucaccau

SEQ ID NO: 1384358 - RNA, 20 nt, Human
uucagaggcaaacauaaauc

SEQ ID NO: 1384359 - RNA, 22 nt, Human
uucagcaggaaaaaaaugcaua

SEQ ID NO: 1384360 - RNA, 18 nt, Human
uuccagcgauucuccugc

SEQ ID NO: 1384361 - RNA, 18 nt, Human
uucucuuucacuagaaag

SEQ ID NO: 1384362 - RNA, 24 nt, Human
uugcccaggcuggaguacaguggu

SEQ ID NO: 1384363 - RNA, 25 nt, Human
uugggaggcugaggcaugagaauca

SEQ ID NO: 1384364 - RNA, 23 nt, Human
uuuaaacaaacaaaacaaaauaa

SEQ ID NO: 1384365 - RNA, 24 nt, Human
uuucaccauguuggccaggcuggu

SEQ ID NO: 1384366 - RNA, 24 nt, Human
uuuuuaguagagacgguguuucac

SEQ ID NO: 1384367 - RNA, 22 nt, Human
uuuuuguauuuuuaguagagaa

SEQ ID NO: 1384368 - RNA, 22 nt, Human
uuuuuuuuuuuuuugagaugga

SEQ ID NO: 1384369 - RNA, 23 nt, Human
uuuuuuuuuuuuuuuuuuuuggg

SEQ ID NO: 1384370 - RNA, 19 nt, Human
aaaagacauuuugugaagg

SEQ ID NO: 1384371 - RNA, 23 nt, Human
aagaacaucaaauuagucugaaa

SEQ ID NO: 1384372 - RNA, 23 nt, Human
aagcaaaggacaucuccccggga

SEQ ID NO: 1384373 - RNA, 20 nt, Human
aagggaacauuaaagaacau

SEQ ID NO: 1384374 - RNA, 20 nt, Human
aauaagggaacauuaaagaa

SEQ ID NO: 1384375 - RNA, 20 nt, Human
acaaugcugagaggcauacc

SEQ ID NO: 1384376 - RNA, 22 nt, Human
acauuaaagaacaucaaauuag

SEQ ID NO: 1384377 - RNA, 22 nt, Human
agcgcgcucgaagcgaccgccu

SEQ ID NO: 1384378 - RNA, 19 nt, Human
caaaaguggccgcgggcac

SEQ ID NO: 1384379 - RNA, 21 nt, Human
caaaauucagauguuuaauuu

SEQ ID NO: 1384380 - RNA, 21 nt, Human
caucugagaagcaaaggacau

SEQ ID NO: 1384381 - RNA, 22 nt, Human
cugagaggcauacucuucuuua

SEQ ID NO: 1384382 - RNA, 21 nt, Human
cuuaaagugcauuuacaucug

SEQ ID NO: 1384383 - RNA, 21 nt, Human
gaagcaaaggacaucuccccg

SEQ ID NO: 1384384 - RNA, 22 nt, Human
gccucgccugccccgccacagc

SEQ ID NO: 1384385 - RNA, 24 nt, Human
ucaaaaauaagggaacauuaaaga

SEQ ID NO: 1384386 - RNA, 19 nt, Human
ucacucccuucagggagcu

SEQ ID NO: 1384387 - RNA, 21 nt, Human
ucuccccgggaaggcaaaagu

SEQ ID NO: 1384388 - RNA, 18 nt, Human
ucuuuuuuuuuuuuuuuu

SEQ ID NO: 1384389 - RNA, 22 nt, Human
uuuuuuuuuuuuuuuucuuuuu

SEQ ID NO: 1384390 - RNA, 21 nt, Human
aaaucaucuucagaugcaugg

SEQ ID NO: 1384391 - RNA, 20 nt, Human
acaaagcaccccaucagaag

SEQ ID NO: 1384392 - RNA, 18 nt, Human
acagggcuucaccaguca

SEQ ID NO: 1384393 - RNA, 29 nt, Human
acucuacuggggacuugugggaggcaacu

SEQ ID NO: 1384394 - RNA, 19 nt, Human
aggcagggcggguaacuac

SEQ ID NO: 1384395 - RNA, 18 nt, Human
augcauggucucucuggg

SEQ ID NO: 1384396 - RNA, 23 nt, Human
cacaacagauaccugaacucccu

SEQ ID NO: 1384397 - RNA, 26 nt, Human
caccccaucucuaaacaaagcacccc

SEQ ID NO: 1384398 - RNA, 24 nt, Human
cagcgugauagaagcagauggcac

SEQ ID NO: 1384399 - RNA, 23 nt, Human
cauuuccauuauacacgugggga

SEQ ID NO: 1384400 - RNA, 23 nt, Human
ccacagugacaacaauacacuuu

SEQ ID NO: 1384401 - RNA, 25 nt, Human
cccagaaagaagguagggcugcgcc

SEQ ID NO: 1384402 - RNA, 21 nt, Human
cccaucucuaaacaaagcacc

SEQ ID NO: 1384403 - RNA, 19 nt, Human
ccccaucucuaaacaaagc

SEQ ID NO: 1384404 - RNA, 20 nt, Human
cccucagagcaggagggccc

SEQ ID NO: 1384405 - RNA, 19 nt, Human
cccuccacggccacucgcc

SEQ ID NO: 1384406 - RNA, 18 nt, Human
cccugaaagggaggcagg

SEQ ID NO: 1384407 - RNA, 20 nt, Human
ccuccugcuucaaguccagg

SEQ ID NO: 1384408 - RNA, 25 nt, Human
ccucuugcuaaucagccuuucugac

SEQ ID NO: 1384409 - RNA, 18 nt, Human
ccuguuggggaacaggug

SEQ ID NO: 1384410 - RNA, 22 nt, Human
ccuugcagauaccuccugcuuc

SEQ ID NO: 1384411 - RNA, 21 nt, Human
cgccuuggcgucugacagucc

SEQ ID NO: 1384412 - RNA, 18 nt, Human
cgcugaagacccgccagg

SEQ ID NO: 1384413 - RNA, 21 nt, Human
cgcugaagacccgccaggcac

SEQ ID NO: 1384414 - RNA, 19 nt, Human
cucauacugggaagccucc

SEQ ID NO: 1384415 - RNA, 23 nt, Human
cucccugccuuccucucucugcc

SEQ ID NO: 1384416 - RNA, 18 nt, Human
cuccucaaaaagguccug

SEQ ID NO: 1384417 - RNA, 23 nt, Human
cuccuuccucucugcaggggcca

SEQ ID NO: 1384418 - RNA, 20 nt, Human
cugcgcaggggcuaccgccu

SEQ ID NO: 1384419 - RNA, 21 nt, Human
cuugcagauaccuccugcuuc

SEQ ID NO: 1384420 - RNA, 20 nt, Human
cuugcgccccuccacggcca

SEQ ID NO: 1384421 - RNA, 18 nt, Human
gaauaucuccuccacugg

SEQ ID NO: 1384422 - RNA, 22 nt, Human
gaccacccugaaagggaggcag

SEQ ID NO: 1384423 - RNA, 19 nt, Human
gacugcgcgggcacagagc

SEQ ID NO: 1384424 - RNA, 19 nt, Human
ggaauaucuccuccacugg

SEQ ID NO: 1384425 - RNA, 19 nt, Human
ggcugugggauccagcagc

SEQ ID NO: 1384426 - RNA, 21 nt, Human
gggaacagguggaggcagccg

SEQ ID NO: 1384427 - RNA, 22 nt, Human
ggggaaacugaggcacacgaca

SEQ ID NO: 1384428 - RNA, 19 nt, Human
ggggcgccuuggcgucuga

SEQ ID NO: 1384429 - RNA, 18 nt, Human
guugggagccggcuggcu

SEQ ID NO: 1384430 - RNA, 22 nt, Human
guugggagccggcuggcugugg

SEQ ID NO: 1384431 - RNA, 21 nt, Human
uaaacaaagcaccccaucaga

SEQ ID NO: 1384432 - RNA, 22 nt, Human
uaaacaaagcaccccaucagaa

SEQ ID NO: 1384433 - RNA, 26 nt, Human
uaccugaacucccucagauguaaaag

SEQ ID NO: 1384434 - RNA, 24 nt, Human
uaguucuggcauggacagaaagag

SEQ ID NO: 1384435 - RNA, 21 nt, Human
ucagaaacuggcaaggaaauu

SEQ ID NO: 1384436 - RNA, 21 nt, Human
ucagccuuucugacucuuccc

SEQ ID NO: 1384437 - RNA, 20 nt, Human
ucaggcacagccuuguugcu

SEQ ID NO: 1384438 - RNA, 24 nt, Human
uccagguucuucaauacccaggag

SEQ ID NO: 1384439 - RNA, 19 nt, Human
ucccucagauguaaaacug

SEQ ID NO: 1384440 - RNA, 19 nt, Human
ucgcugaagacccgccagg

SEQ ID NO: 1384441 - RNA, 22 nt, Human
ucgcugaagacccgccaggcac

SEQ ID NO: 1384442 - RNA, 18 nt, Human
ucucuaaacaaagcaccc

SEQ ID NO: 1384443 - RNA, 18 nt, Human
ucucucugccgcaccucu

SEQ ID NO: 1384444 - RNA, 20 nt, Human
ucucugcaggggccagacuc

SEQ ID NO: 1384445 - RNA, 22 nt, Human
ucucugggaccucaugaccacc

SEQ ID NO: 1384446 - RNA, 21 nt, Human
ucugggaccucaugaccaccc

SEQ ID NO: 1384447 - RNA, 21 nt, Human
ugacaacaauacacuuucaug

SEQ ID NO: 1384448 - RNA, 24 nt, Human
ugaggucccauggcauggguguug

SEQ ID NO: 1384449 - RNA, 21 nt, Human
ugccuugcgccccuccacggc

SEQ ID NO: 1384450 - RNA, 18 nt, Human
uggacagaaagagggguu

SEQ ID NO: 1384451 - RNA, 23 nt, Human
uggcaacuccucaaaaagguccu

SEQ ID NO: 1384452 - RNA, 19 nt, Human
uggcauggacagaaagagg

SEQ ID NO: 1384453 - RNA, 23 nt, Human
uggcauggacagaaagagggguu

SEQ ID NO: 1384454 - RNA, 19 nt, Human
uggcauggguguugggagc

SEQ ID NO: 1384455 - RNA, 22 nt, Human
uggcauggguguugggagccgg

SEQ ID NO: 1384456 - RNA, 18 nt, Human
uggggacuugugggaggc

SEQ ID NO: 1384457 - RNA, 24 nt, Human
uugcugaggucccauggcaugggu

SEQ ID NO: 1384458 - RNA, 21 nt, Human
uugggagccggcuggcugugg

SEQ ID NO: 1384459 - RNA, 23 nt, Human
uuuuuuuuuuuuuuuuuuucagg

SEQ ID NO: 1384460 - RNA, 27 nt, Human
aaaaaagaaaaucacacuccacaaaga

SEQ ID NO: 1384461 - RNA, 23 nt, Human
aaaaauaaucaggcuugaauggc

SEQ ID NO: 1384462 - RNA, 18 nt, Human
aaagaaaaucacacucca

SEQ ID NO: 1384463 - RNA, 21 nt, Human
aaauagcuucagcuaccuucu

SEQ ID NO: 1384464 - RNA, 19 nt, Human
aaaugcugguggugggaac

SEQ ID NO: 1384465 - RNA, 18 nt, Human
aaccaaggacacagaaua

SEQ ID NO: 1384466 - RNA, 22 nt, Human
aagaaaaugugaacacaaagca

SEQ ID NO: 1384467 - RNA, 23 nt, Human
aagacuuccuccacucccucugg

SEQ ID NO: 1384468 - RNA, 19 nt, Human
aagcggauucuagaaggcc

SEQ ID NO: 1384469 - RNA, 26 nt, Human
acaaaacccuuagucugcaucacacc

SEQ ID NO: 1384470 - RNA, 20 nt, Human
acaaacuuucauuuuccagg

SEQ ID NO: 1384471 - RNA, 22 nt, Human
acaaauaugugaaaaaagaaaa

SEQ ID NO: 1384472 - RNA, 18 nt, Human
acccaguaaaacacauuu

SEQ ID NO: 1384473 - RNA, 25 nt, Human
acucacccucuccucucuuccuucu

SEQ ID NO: 1384474 - RNA, 20 nt, Human
acugagcauccuuuugagcc

SEQ ID NO: 1384475 - RNA, 23 nt, Human
agaugugacauuacauguccaua

SEQ ID NO: 1384476 - RNA, 18 nt, Human
agcaggcuugcacaacug

SEQ ID NO: 1384477 - RNA, 23 nt, Human
agcuaccuucuccggcccacauc

SEQ ID NO: 1384478 - RNA, 23 nt, Human
agcuucagcuaccuucuccggcc

SEQ ID NO: 1384479 - RNA, 19 nt, Human
aggaagggauuuggucacu

SEQ ID NO: 1384480 - RNA, 19 nt, Human
aggacaaucuuucucacuu

SEQ ID NO: 1384481 - RNA, 21 nt, Human
agggagccacccugggcccua

SEQ ID NO: 1384482 - RNA, 19 nt, Human
aggguucuaacugguugug

SEQ ID NO: 1384483 - RNA, 20 nt, Human
auagcuucagcuaccuucuc

SEQ ID NO: 1384484 - RNA, 22 nt, Human
aucacacuccacaaagauguga

SEQ ID NO: 1384485 - RNA, 24 nt, Human
aucagccaaggguuaagcggauuc

SEQ ID NO: 1384486 - RNA, 23 nt, Human
augcaaagcaacgugaauuucca

SEQ ID NO: 1384487 - RNA, 19 nt, Human
auuagaaaagaaaauguga

SEQ ID NO: 1384488 - RNA, 23 nt, Human
caacugaccaaagacggacacag

SEQ ID NO: 1384489 - RNA, 20 nt, Human
caaggguauaguugcugcgc

SEQ ID NO: 1384490 - RNA, 23 nt, Human
cacaacugaccaaagacggacac

SEQ ID NO: 1384491 - RNA, 19 nt, Human
cacacuccacaaagaugug

SEQ ID NO: 1384492 - RNA, 19 nt, Human
cacccaagacuuccuccac

SEQ ID NO: 1384493 - RNA, 21 nt, Human
cacccucuccucucuuccuuc

SEQ ID NO: 1384494 - RNA, 23 nt, Human
caggaaaugcuacagacucaagg

SEQ ID NO: 1384495 - RNA, 23 nt, Human
caggaaaugcuacagacucaagg

SEQ ID NO: 1384496 - RNA, 21 nt, Human
caguacagcaagauacaggga

SEQ ID NO: 1384497 - RNA, 20 nt, Human
ccacaccacccaagacuucc

SEQ ID NO: 1384498 - RNA, 21 nt, Human
ccacccaagacuuccuccacu

SEQ ID NO: 1384499 - RNA, 22 nt, Human
ccacccaagacuuccuccacuc

SEQ ID NO: 1384500 - RNA, 22 nt, Human
ccaguaaaacacauugcguaaa

SEQ ID NO: 1384501 - RNA, 20 nt, Human
cccacucacccucuccucuc

SEQ ID NO: 1384502 - RNA, 20 nt, Human
ccugcugacauagagguggg

SEQ ID NO: 1384503 - RNA, 20 nt, Human
cgggggagugauguggucag

SEQ ID NO: 1384504 - RNA, 20 nt, Human
cucuuccuucuguccacacc

SEQ ID NO: 1384505 - RNA, 19 nt, Human
cuguucccacugagcaucc

SEQ ID NO: 1384506 - RNA, 22 nt, Human
cuucuggaccuaacaaagugua

SEQ ID NO: 1384507 - RNA, 23 nt, Human
gaaaaccccccaaaaagcacacu

SEQ ID NO: 1384508 - RNA, 20 nt, Human
gaacucgggggagugaugug

SEQ ID NO: 1384509 - RNA, 21 nt, Human
gagccugaggaguagggagcc

SEQ ID NO: 1384510 - RNA, 18 nt, Human
gauugugugugugugugu

SEQ ID NO: 1384511 - RNA, 25 nt, Human
gauugugugugugugugugugugug

SEQ ID NO: 1384512 - RNA, 23 nt, Human
gcaaaguauacucgguggaaccc

SEQ ID NO: 1384513 - RNA, 22 nt, Human
gcaacgugaauuuccauugaaa

SEQ ID NO: 1384514 - RNA, 20 nt, Human
gccuccuggaaccuguguuc

SEQ ID NO: 1384515 - RNA, 20 nt, Human
gcugcccacugagcuugcug

SEQ ID NO: 1384516 - RNA, 19 nt, Human
gcuugcugugagcuuuaca

SEQ ID NO: 1384517 - RNA, 20 nt, Human
ggucaguccugcugacauag

SEQ ID NO: 1384518 - RNA, 21 nt, Human
guaguaugggcagcuccuucu

SEQ ID NO: 1384519 - RNA, 20 nt, Human
guauuuuuuuuuuaauggaa

SEQ ID NO: 1384520 - RNA, 21 nt, Human
gugugugugugugugugugug

SEQ ID NO: 1384521 - RNA, 21 nt, Human
gugugugugugugugugugug

SEQ ID NO: 1384522 - RNA, 23 nt, Human
uaaaacacauugcguaaaucucc

SEQ ID NO: 1384523 - RNA, 23 nt, Human
uaagguccagauucucaauucca

SEQ ID NO: 1384524 - RNA, 22 nt, Human
uacaaauaugugaaaaaagaaa

SEQ ID NO: 1384525 - RNA, 24 nt, Human
uaccccacucacccucuccucucu

SEQ ID NO: 1384526 - RNA, 25 nt, Human
uacucgguggaacccuagcucugug

SEQ ID NO: 1384527 - RNA, 18 nt, Human
uacugcauacaaauaugu

SEQ ID NO: 1384528 - RNA, 23 nt, Human
uaucagaagucccauuucugagg

SEQ ID NO: 1384529 - RNA, 24 nt, Human
uaugugaaaaaagaaaaucacacu

SEQ ID NO: 1384530 - RNA, 25 nt, Human
ucaaggauuauuuuuggggauucac

SEQ ID NO: 1384531 - RNA, 23 nt, Human
ucacaaguggauuucuuuaacca

SEQ ID NO: 1384532 - RNA, 22 nt, Human
ucaggcuugaauggcuuuuccu

SEQ ID NO: 1384533 - RNA, 21 nt, Human
uccaaacuaugaaacugaaga

SEQ ID NO: 1384534 - RNA, 24 nt, Human
uccaaacuaugaaacugaagaagc

SEQ ID NO: 1384535 - RNA, 23 nt, Human
uccacaccacccaagacuuccuc

SEQ ID NO: 1384536 - RNA, 19 nt, Human
uccauaugccauacugagc

SEQ ID NO: 1384537 - RNA, 20 nt, Human
uccauugaaaaccccccaaa

SEQ ID NO: 1384538 - RNA, 21 nt, Human
ucccucauuccagaaaccuau

SEQ ID NO: 1384539 - RNA, 23 nt, Human
ucugcaaaaacaguugaauccau

SEQ ID NO: 1384540 - RNA, 20 nt, Human
ucugcaaaauagaguauccu

SEQ ID NO: 1384541 - RNA, 20 nt, Human
ugaaaaccccccaaaaagca

SEQ ID NO: 1384542 - RNA, 18 nt, Human
ugaacacaaagcaaaaca

SEQ ID NO: 1384543 - RNA, 21 nt, Human
ugaacacaaagcaaaacacgg

SEQ ID NO: 1384544 - RNA, 19 nt, Human
ugaccaaagacggacacag

SEQ ID NO: 1384545 - RNA, 18 nt, Human
ugaccacaaaacccuuag

SEQ ID NO: 1384546 - RNA, 18 nt, Human
ugagauguugcagcugcu

SEQ ID NO: 1384547 - RNA, 26 nt, Human
ugagauugugugugugugugugugug

SEQ ID NO: 1384548 - RNA, 18 nt, Human
ugcacagcacacauugaa

SEQ ID NO: 1384549 - RNA, 24 nt, Human
ugcagcugcugcccacugagcuug

SEQ ID NO: 1384550 - RNA, 26 nt, Human
ugcucauaagaaaguaguaugggcag

SEQ ID NO: 1384551 - RNA, 23 nt, Human
ugcugcgcccuucacaaagggga

SEQ ID NO: 1384552 - RNA, 21 nt, Human
ugggaacucgggggagugaug

SEQ ID NO: 1384553 - RNA, 22 nt, Human
ugggaacucgggggagugaugu

SEQ ID NO: 1384554 - RNA, 22 nt, Human
ugggagggauagaauuguaguu

SEQ ID NO: 1384555 - RNA, 19 nt, Human
ugugaacacaaagcaaaac

SEQ ID NO: 1384556 - RNA, 18 nt, Human
ugugugugugugugugug

SEQ ID NO: 1384557 - RNA, 18 nt, Human
ugugugugugugugugug

SEQ ID NO: 1384558 - RNA, 18 nt, Human
ugugugugugugugugug

SEQ ID NO: 1384559 - RNA, 18 nt, Human
ugugugugugugugugug

SEQ ID NO: 1384560 - RNA, 18 nt, Human
ugugugugugugugugug

SEQ ID NO: 1384561 - RNA, 18 nt, Human
ugugugugugugugugug

SEQ ID NO: 1384562 - RNA, 18 nt, Human
ugugugugugugugugug

SEQ ID NO: 1384563 - RNA, 18 nt, Human
ugugugugugugugugug

SEQ ID NO: 1384564 - RNA, 18 nt, Human
ugugugugugugugugug

SEQ ID NO: 1384565 - RNA, 18 nt, Human
ugugugugugugugugug

SEQ ID NO: 1384566 - RNA, 21 nt, Human
ugugugugugugugugugugu

SEQ ID NO: 1384567 - RNA, 21 nt, Human
ugugugugugugugugugugu

SEQ ID NO: 1384568 - RNA, 21 nt, Human
ugugugugugugugugugugu

SEQ ID NO: 1384569 - RNA, 21 nt, Human
ugugugugugugugugugugu

SEQ ID NO: 1384570 - RNA, 21 nt, Human
ugugugugugugugugugugu

SEQ ID NO: 1384571 - RNA, 21 nt, Human
ugugugugugugugugugugu

SEQ ID NO: 1384572 - RNA, 21 nt, Human
ugugugugugugugugugugu

SEQ ID NO: 1384573 - RNA, 21 nt, Human
ugugugugugugugugugugu

SEQ ID NO: 1384574 - RNA, 21 nt, Human
ugugugugugugugugugugu

SEQ ID NO: 1384575 - RNA, 21 nt, Human
ugugugugugugugugugugu

SEQ ID NO: 1384576 - RNA, 21 nt, Human
ugugugugugugugugugugu

SEQ ID NO: 1384577 - RNA, 21 nt, Human
ugugugugugugugugugugu

SEQ ID NO: 1384578 - RNA, 21 nt, Human
ugugugugugugugugugugu

SEQ ID NO: 1384579 - RNA, 21 nt, Human
ugugugugugugugugugugu

SEQ ID NO: 1384580 - RNA, 21 nt, Human
ugugugugugugugugugugu

SEQ ID NO: 1384581 - RNA, 21 nt, Human
ugugugugugugugugugugu

SEQ ID NO: 1384582 - RNA, 22 nt, Human
ugugugugugugugugugugua

SEQ ID NO: 1384583 - RNA, 22 nt, Human
ugugugugugugugugugugug

SEQ ID NO: 1384584 - RNA, 22 nt, Human
ugugugugugugugugugugug

SEQ ID NO: 1384585 - RNA, 22 nt, Human
ugugugugugugugugugugug

SEQ ID NO: 1384586 - RNA, 22 nt, Human
ugugugugugugugugugugug

SEQ ID NO: 1384587 - RNA, 22 nt, Human
ugugugugugugugugugugug

SEQ ID NO: 1384588 - RNA, 21 nt, Human
uuagaaaauguuggacaaccu

SEQ ID NO: 1384589 - RNA, 21 nt, Human
uuauuuuuggggauucaccau

SEQ ID NO: 1384590 - RNA, 27 nt, Human
uuggcaauguggaauucagcuuucuuu

SEQ ID NO: 1384591 - RNA, 18 nt, Human
uuuaacaguacagcaaga

SEQ ID NO: 1384592 - RNA, 19 nt, Human
uuuagaauauccucacccc

SEQ ID NO: 1384593 - RNA, 25 nt, Human
uuucuacauucugcaaaaacaguug

SEQ ID NO: 1384594 - RNA, 20 nt, Human
aaaggaaaauaauagcgagg

SEQ ID NO: 1384595 - RNA, 27 nt, Human
aagcaaaagcuucugugaacugugauc

SEQ ID NO: 1384596 - RNA, 28 nt, Human
aagcauacagcccccucaccugcaagcc

SEQ ID NO: 1384597 - RNA, 22 nt, Human
aagggaaugaagggaaaaggaa

SEQ ID NO: 1384598 - RNA, 19 nt, Human
acucagugacggcuccugg

SEQ ID NO: 1384599 - RNA, 21 nt, Human
agcacagggcccacccucuca

SEQ ID NO: 1384600 - RNA, 23 nt, Human
agcagguacucagggugcugguc

SEQ ID NO: 1384601 - RNA, 24 nt, Human
agcccagccacacucaaccccugg

SEQ ID NO: 1384602 - RNA, 21 nt, Human
agcccccucaccugcaagccc

SEQ ID NO: 1384603 - RNA, 19 nt, Human
aggaagagcgggucugaga

SEQ ID NO: 1384604 - RNA, 19 nt, Human
aggcauagaggaggccagc

SEQ ID NO: 1384605 - RNA, 21 nt, Human
aguuccugaagcauacagccc

SEQ ID NO: 1384606 - RNA, 20 nt, Human
aucucacaagcacuugguug

SEQ ID NO: 1384607 - RNA, 25 nt, Human
aucuggcucagccaggucucccagg

SEQ ID NO: 1384608 - RNA, 18 nt, Human
augaagggaaaaggaaga

SEQ ID NO: 1384609 - RNA, 23 nt, Human
auggcugacucucaagggaauga

SEQ ID NO: 1384610 - RNA, 19 nt, Human
cacacaguccuaucgauaa

SEQ ID NO: 1384611 - RNA, 20 nt, Human
caccccaguguucacuccca

SEQ ID NO: 1384612 - RNA, 22 nt, Human
caccugcaagccccgccucagc

SEQ ID NO: 1384613 - RNA, 19 nt, Human
cacuugccagggcagcuuc

SEQ ID NO: 1384614 - RNA, 21 nt, Human
cagggcagcuucaguuccugc

SEQ ID NO: 1384615 - RNA, 23 nt, Human
cagugacggcuccugguuccuca

SEQ ID NO: 1384616 - RNA, 18 nt, Human
caucuggcucagccaggu

SEQ ID NO: 1384617 - RNA, 20 nt, Human
caugcgcccuuacccuuacc

SEQ ID NO: 1384618 - RNA, 18 nt, Human
cauuccaugcgcccuuac

SEQ ID NO: 1384619 - RNA, 21 nt, Human
cauuccaugcgcccuuacccu

SEQ ID NO: 1384620 - RNA, 18 nt, Human
ccagugccgcacggccga

SEQ ID NO: 1384621 - RNA, 18 nt, Human
ccccccagcacagggccc

SEQ ID NO: 1384622 - RNA, 20 nt, Human
ccugcaagccccgccucagc

SEQ ID NO: 1384623 - RNA, 28 nt, Human
cgauaacuuccagcagauaacccaagug

SEQ ID NO: 1384624 - RNA, 24 nt, Human
cgccucagcgcacacccuugccag

SEQ ID NO: 1384625 - RNA, 19 nt, Human
cggcuccugguuccucacu

SEQ ID NO: 1384626 - RNA, 19 nt, Human
cucaagggaaugaagggaa

SEQ ID NO: 1384627 - RNA, 18 nt, Human
cucagcgcacacccuugc

SEQ ID NO: 1384628 - RNA, 21 nt, Human
cucaucgcaguaucaaaauaa

SEQ ID NO: 1384629 - RNA, 22 nt, Human
cuguuaggugagcucauuccug

SEQ ID NO: 1384630 - RNA, 22 nt, Human
cuuacucaucgcaguaucaaaa

SEQ ID NO: 1384631 - RNA, 21 nt, Human
gaaugggcucugcugagaucu

SEQ ID NO: 1384632 - RNA, 23 nt, Human
gacacauuugcuaucuguuaggu

SEQ ID NO: 1384633 - RNA, 21 nt, Human
gagguccagugccgcacggcc

SEQ ID NO: 1384634 - RNA, 21 nt, Human
ggccgagggaggucaggaacc

SEQ ID NO: 1384635 - RNA, 25 nt, Human
ggguggaagccaggucucgguuccu

SEQ ID NO: 1384636 - RNA, 24 nt, Human
ucacucccaccuuagccccauucc

SEQ ID NO: 1384637 - RNA, 19 nt, Human
ucagcgcacacccuugcca

SEQ ID NO: 1384638 - RNA, 27 nt, Human
ucccgcugcguuacugaaaggucggac

SEQ ID NO: 1384639 - RNA, 26 nt, Human
ucccgcugcguuacugaaaggucggc

SEQ ID NO: 1384640 - RNA, 23 nt, Human
uccugccgcggugucagugcaga

SEQ ID NO: 1384641 - RNA, 18 nt, Human
ucugcugagaucuaacca

SEQ ID NO: 1384642 - RNA, 22 nt, Human
ugaacaccucccaucaugccuc

SEQ ID NO: 1384643 - RNA, 18 nt, Human
ugaagggaaaaggaagag

SEQ ID NO: 1384644 - RNA, 23 nt, Human
ugaagggaaaaggaagagcgggu

SEQ ID NO: 1384645 - RNA, 21 nt, Human
ugacccaaggccccccagcac

SEQ ID NO: 1384646 - RNA, 19 nt, Human
ugagcucauuccuggaacc

SEQ ID NO: 1384647 - RNA, 20 nt, Human
ugcagaaugggcucugcuga

SEQ ID NO: 1384648 - RNA, 20 nt, Human
ugccagguuggaggaagucc

SEQ ID NO: 1384649 - RNA, 22 nt, Human
ugccgcacggccgagggagguc

SEQ ID NO: 1384650 - RNA, 20 nt, Human
ugugugugacccaaggcccc

SEQ ID NO: 1384651 - RNA, 21 nt, Human
uuacucaucgcaguaucaaaa

SEQ ID NO: 1384652 - RNA, 21 nt, Human
uucacucccaccuuagcccca

SEQ ID NO: 1384653 - RNA, 22 nt, Human
uugcuuuguuuuugcaguguca

SEQ ID NO: 1384654 - RNA, 22 nt, Human
gcaguagacgcagcaaagaaag

SEQ ID NO: 1384655 - RNA, 20 nt, Human
gucuuaagugucaucuggcc

SEQ ID NO: 1384656 - RNA, 24 nt, Human
ucuuaagugucaucuggcaucuuc

SEQ ID NO: 1384657 - RNA, 22 nt, Human
aaaaaaaaaaaauuaaaccaac

SEQ ID NO: 1384658 - RNA, 26 nt, Human
aaaaaaaaaaauuaaaccaacaauug

SEQ ID NO: 1384659 - RNA, 22 nt, Human
aaacccaagggacagacugaug

SEQ ID NO: 1384660 - RNA, 19 nt, Human
aaagcuagaccaaugccuu

SEQ ID NO: 1384661 - RNA, 20 nt, Human
aacccaucgaaaucuucccc

SEQ ID NO: 1384662 - RNA, 18 nt, Human
aagcaagaauguggaacc

SEQ ID NO: 1384663 - RNA, 22 nt, Human
aagcaagaauguggaacccauc

SEQ ID NO: 1384664 - RNA, 19 nt, Human
aagcgccucgggaacccca

SEQ ID NO: 1384665 - RNA, 18 nt, Human
aagcucucccugccuccc

SEQ ID NO: 1384666 - RNA, 18 nt, Human
aaggacucaggccugggg

SEQ ID NO: 1384667 - RNA, 22 nt, Human
aaggcccagcccagaggacccu

SEQ ID NO: 1384668 - RNA, 22 nt, Human
acaagcucucccugccuccccu

SEQ ID NO: 1384669 - RNA, 21 nt, Human
acaauuggcugccuucugacc

SEQ ID NO: 1384670 - RNA, 18 nt, Human
acagcgaaaccccgucuc

SEQ ID NO: 1384671 - RNA, 26 nt, Human
acuaaagcaagaauguggaacccagu

SEQ ID NO: 1384672 - RNA, 18 nt, Human
acuacacuccagccuggg

SEQ ID NO: 1384673 - RNA, 24 nt, Human
acuacacuccagccugggaaacag

SEQ ID NO: 1384674 - RNA, 24 nt, Human
agaaauaaagaaaggaaucccagc

SEQ ID NO: 1384675 - RNA, 22 nt, Human
agaccccagcccuggaccagga

SEQ ID NO: 1384676 - RNA, 22 nt, Human
agaguagcuugcaaaacccaag

SEQ ID NO: 1384677 - RNA, 24 nt, Human
agcacuuugggaggccgaggcggg

SEQ ID NO: 1384678 - RNA, 22 nt, Human
agcguggggcuagggcaguggg

SEQ ID NO: 1384679 - RNA, 20 nt, Human
aggaguuugagaccagccug

SEQ ID NO: 1384680 - RNA, 24 nt, Human
aggccgaggcgggagguucacuug

SEQ ID NO: 1384681 - RNA, 20 nt, Human
aggcggcgggcgcccaggaa

SEQ ID NO: 1384682 - RNA, 18 nt, Human
aggcgggagguucacuug

SEQ ID NO: 1384683 - RNA, 18 nt, Human
aguagcuugcaaaaccca

SEQ ID NO: 1384684 - RNA, 19 nt, Human
agugggggaagguggggag

SEQ ID NO: 1384685 - RNA, 20 nt, Human
agugggucaggcaccauccc

SEQ ID NO: 1384686 - RNA, 18 nt, Human
cacaccuguaguaccagc

SEQ ID NO: 1384687 - RNA, 19 nt, Human
cacagccugcagcuccccc

SEQ ID NO: 1384688 - RNA, 19 nt, Human
caccuguaguaccagcuac

SEQ ID NO: 1384689 - RNA, 22 nt, Human
caccuguaguaccagcuacuca

SEQ ID NO: 1384690 - RNA, 18 nt, Human
cacuacacuccagccugg

SEQ ID NO: 1384691 - RNA, 19 nt, Human
cacuacacuccagccuggg

SEQ ID NO: 1384692 - RNA, 24 nt, Human
cacuacacuccagccugggaaaca

SEQ ID NO: 1384693 - RNA, 21 nt, Human
cagacugauggggaaaauccc

SEQ ID NO: 1384694 - RNA, 18 nt, Human
cagcacugaaggucccac

SEQ ID NO: 1384695 - RNA, 23 nt, Human
cagcacugaaggucccacaagcu

SEQ ID NO: 1384696 - RNA, 22 nt, Human
cagcacuuugggaggccgaggc

SEQ ID NO: 1384697 - RNA, 24 nt, Human
cagcacuuugggaggccgaggcgg

SEQ ID NO: 1384698 - RNA, 20 nt, Human
cagcccagaggacccugcgg

SEQ ID NO: 1384699 - RNA, 22 nt, Human
caggagccggagcgggacagcg

SEQ ID NO: 1384700 - RNA, 25 nt, Human
caggagccggagcgggacagcggag

SEQ ID NO: 1384701 - RNA, 23 nt, Human
cagugggucaggcaccaucccuu

SEQ ID NO: 1384702 - RNA, 19 nt, Human
caucccuucugcaaguggc

SEQ ID NO: 1384703 - RNA, 22 nt, Human
cauccuguauaggaauggaaau

SEQ ID NO: 1384704 - RNA, 18 nt, Human
ccaggacggggagaacaa

SEQ ID NO: 1384705 - RNA, 21 nt, Human
cccaaaucccucuacaacaac

SEQ ID NO: 1384706 - RNA, 19 nt, Human
cccacaagcucucccugcc

SEQ ID NO: 1384707 - RNA, 22 nt, Human
cccagcccagaggacccugcgg

SEQ ID NO: 1384708 - RNA, 21 nt, Human
cccaucgaaaucuucccccaa

SEQ ID NO: 1384709 - RNA, 22 nt, Human
ccccaaaaugccaaccauaaaa

SEQ ID NO: 1384710 - RNA, 25 nt, Human
ccccaaggcccagcccagaggaccc

SEQ ID NO: 1384711 - RNA, 18 nt, Human
ccccagccgggccggccc

SEQ ID NO: 1384712 - RNA, 28 nt, Human
cccccaaaaugccaaccauaaaauagag

SEQ ID NO: 1384713 - RNA, 19 nt, Human
cccccaguggagcaagaaa

SEQ ID NO: 1384714 - RNA, 20 nt, Human
cccccaguggagcaagaaaa

SEQ ID NO: 1384715 - RNA, 19 nt, Human
cccccugcaggcgauucag

SEQ ID NO: 1384716 - RNA, 24 nt, Human
cccucuacaacaacuaaagcaaga

SEQ ID NO: 1384717 - RNA, 23 nt, Human
cccugcggccucuuacagacccc

SEQ ID NO: 1384718 - RNA, 20 nt, Human
ccggagcgggacagcggagg

SEQ ID NO: 1384719 - RNA, 18 nt, Human
ccuccaaagauagguuca

SEQ ID NO: 1384720 - RNA, 27 nt, Human
ccucgggaaccccagccgggccggccc

SEQ ID NO: 1384721 - RNA, 22 nt, Human
ccucuacaacaacuaaagcaag

SEQ ID NO: 1384722 - RNA, 21 nt, Human
ccugggaacagcgaaaccccg

SEQ ID NO: 1384723 - RNA, 19 nt, Human
ccuguaguaccagcuacuc

SEQ ID NO: 1384724 - RNA, 22 nt, Human
cuaaagcaagaauguggaaccc

SEQ ID NO: 1384725 - RNA, 18 nt, Human
cuaacaccagucucacac

SEQ ID NO: 1384726 - RNA, 21 nt, Human
cuacagaaauaaagaaaggaa

SEQ ID NO: 1384727 - RNA, 18 nt, Human
cuacucacuaccugggag

SEQ ID NO: 1384728 - RNA, 27 nt, Human
cucaaaaaaaaaaaaaaauuaaaccaa

SEQ ID NO: 1384729 - RNA, 19 nt, Human
cucacuaccugggaggcug

SEQ ID NO: 1384730 - RNA, 19 nt, Human
cugaaggucccacaagcuc

SEQ ID NO: 1384731 - RNA, 19 nt, Human
cugcagcucccccugcagg

SEQ ID NO: 1384732 - RNA, 22 nt, Human
cugucucaaaaaaaaaaaaaaa

SEQ ID NO: 1384733 - RNA, 23 nt, Human
cuuaaaaccuccuuacccaaccc

SEQ ID NO: 1384734 - RNA, 22 nt, Human
gaacagcgaaaccccgucucua

SEQ ID NO: 1384735 - RNA, 24 nt, Human
gagccggagcgggacagcggaggc

SEQ ID NO: 1384736 - RNA, 22 nt, Human
gcccaggaguuugagaccagcc

SEQ ID NO: 1384737 - RNA, 25 nt, Human
gccccaaggcccagcccagaggacc

SEQ ID NO: 1384738 - RNA, 26 nt, Human
gccccaggagccggagcgggacagcg

SEQ ID NO: 1384739 - RNA, 22 nt, Human
gccucgggaaccccagccgggc

SEQ ID NO: 1384740 - RNA, 18 nt, Human
gcgccucgggaaccccag

SEQ ID NO: 1384741 - RNA, 19 nt, Human
gcggggagccccaggagcc

SEQ ID NO: 1384742 - RNA, 18 nt, Human
gcuaacaccagucucaca

SEQ ID NO: 1384743 - RNA, 19 nt, Human
ggaaugugggagcugcccc

SEQ ID NO: 1384744 - RNA, 24 nt, Human
ggcagcacacaccuguaguaccag

SEQ ID NO: 1384745 - RNA, 23 nt, Human
gggaaccccagccgggccggccc

SEQ ID NO: 1384746 - RNA, 22 nt, Human
gggagguucacuugagcccagg

SEQ ID NO: 1384747 - RNA, 26 nt, Human
gggcaggaaucugaacucugccugag

SEQ ID NO: 1384748 - RNA, 18 nt, Human
gggggaagguggggagcu

SEQ ID NO: 1384749 - RNA, 22 nt, Human
gggggaagguggggagcuugaa

SEQ ID NO: 1384750 - RNA, 22 nt, Human
ggucaccacagugggggaaggu

SEQ ID NO: 1384751 - RNA, 21 nt, Human
ggugggagcaucuuuugagcc

SEQ ID NO: 1384752 - RNA, 18 nt, Human
guggagcaagaaaagcag

SEQ ID NO: 1384753 - RNA, 24 nt, Human
guucacuugagcccaggaguuuga

SEQ ID NO: 1384754 - RNA, 18 nt, Human
uaaagaaaggaaucccag

SEQ ID NO: 1384755 - RNA, 21 nt, Human
uaaagaccccagcccuggacc

SEQ ID NO: 1384756 - RNA, 20 nt, Human
uaaagcaagaauguggaacc

SEQ ID NO: 1384757 - RNA, 21 nt, Human
uaaagcaagaauguggaaccc

SEQ ID NO: 1384758 - RNA, 24 nt, Human
uaaagcaagaauguggaacccauc

SEQ ID NO: 1384759 - RNA, 18 nt, Human
uaacaccagucucacaca

SEQ ID NO: 1384760 - RNA, 19 nt, Human
uacaacaacuaaagcaaga

SEQ ID NO: 1384761 - RNA, 21 nt, Human
uacccaacccuugcuaaggac

SEQ ID NO: 1384762 - RNA, 23 nt, Human
uagaaacacccaaaucccucuac

SEQ ID NO: 1384763 - RNA, 20 nt, Human
uaggaaaagcuagaccaaug

SEQ ID NO: 1384764 - RNA, 18 nt, Human
uagggcagugggucaggc

SEQ ID NO: 1384765 - RNA, 20 nt, Human
uauaaaacaaggugcaucca

SEQ ID NO: 1384766 - RNA, 20 nt, Human
uauauaaaacaaggugcauc

SEQ ID NO: 1384767 - RNA, 19 nt, Human
ucacuacacuccagccugg

SEQ ID NO: 1384768 - RNA, 19 nt, Human
ucacuugagcccaggaguu

SEQ ID NO: 1384769 - RNA, 22 nt, Human
ucccccaaaaugccaaccauaa

SEQ ID NO: 1384770 - RNA, 19 nt, Human
ucccugccuccccucuauc

SEQ ID NO: 1384771 - RNA, 22 nt, Human
ucccuucugcaaguggccacag

SEQ ID NO: 1384772 - RNA, 25 nt, Human
ucuaaagaccccagcccuggaccag

SEQ ID NO: 1384773 - RNA, 19 nt, Human
ucucuaaagaccccagccc

SEQ ID NO: 1384774 - RNA, 18 nt, Human
ucuuacagaccccggagg

SEQ ID NO: 1384775 - RNA, 23 nt, Human
ugacuguaucacuacacuccagc

SEQ ID NO: 1384776 - RNA, 23 nt, Human
ugagcccaggaguuugagaccag

SEQ ID NO: 1384777 - RNA, 23 nt, Human
ugcagugagcgguggcuaacacc

SEQ ID NO: 1384778 - RNA, 23 nt, Human
ugcauagcguggggcuagggcag

SEQ ID NO: 1384779 - RNA, 23 nt, Human
ugccuccccucuaucuacugguc

SEQ ID NO: 1384780 - RNA, 18 nt, Human
uggaaguggcuccagcca

SEQ ID NO: 1384781 - RNA, 20 nt, Human
uggaaguggcuccagccagg

SEQ ID NO: 1384782 - RNA, 24 nt, Human
uggaaguggcuccagccccgaccc

SEQ ID NO: 1384783 - RNA, 19 nt, Human
uggccacaggucaccacag

SEQ ID NO: 1384784 - RNA, 21 nt, Human
uggcuaacaccagucucacac

SEQ ID NO: 1384785 - RNA, 23 nt, Human
uggcuccagccaggggauggggg

SEQ ID NO: 1384786 - RNA, 21 nt, Human
ugggaacagcgaaaccccguc

SEQ ID NO: 1384787 - RNA, 19 nt, Human
ugggagcugccccaaggcc

SEQ ID NO: 1384788 - RNA, 23 nt, Human
ugggagcugccccaaggcccagc

SEQ ID NO: 1384789 - RNA, 19 nt, Human
ugggaggccgaggcgggag

SEQ ID NO: 1384790 - RNA, 18 nt, Human
ugggaggcugugguggga

SEQ ID NO: 1384791 - RNA, 23 nt, Human
uucacuugagcccaggaguuuga

SEQ ID NO: 1384792 - RNA, 22 nt, Human
uugagcccaggaguuugagacc

SEQ ID NO: 1384793 - RNA, 19 nt, Human
aaagugcuaggauuacaga

SEQ ID NO: 1384794 - RNA, 24 nt, Human
aaagugcugggauuacagguguga

SEQ ID NO: 1384795 - RNA, 20 nt, Human
aaccuccgccucccagcuuc

SEQ ID NO: 1384796 - RNA, 24 nt, Human
aagacuccucccacugaguaacag

SEQ ID NO: 1384797 - RNA, 20 nt, Human
aagagucuaagaucaaggug

SEQ ID NO: 1384798 - RNA, 18 nt, Human
aagauuugaaggcugaag

SEQ ID NO: 1384799 - RNA, 25 nt, Human
aagcgauccucccaucuuggccucc

SEQ ID NO: 1384800 - RNA, 24 nt, Human
aagcuggucucgagccgugacaca

SEQ ID NO: 1384801 - RNA, 26 nt, Human
aagugcuaggauuacagacuucagcc

SEQ ID NO: 1384802 - RNA, 18 nt, Human
aagugcugggauuacagg

SEQ ID NO: 1384803 - RNA, 19 nt, Human
aagugcugggauuacaggu

SEQ ID NO: 1384804 - RNA, 26 nt, Human
aagugcugggauuacaggugugagcc

SEQ ID NO: 1384805 - RNA, 26 nt, Human
aaucaucuuguucuuccccuuccccu

SEQ ID NO: 1384806 - RNA, 23 nt, Human
aaucccucccaaaggcccacuuc

SEQ ID NO: 1384807 - RNA, 24 nt, Human
aaucgcuugaacccgggaggcgga

SEQ ID NO: 1384808 - RNA, 21 nt, Human
acaacacacauuuauuccuca

SEQ ID NO: 1384809 - RNA, 24 nt, Human
acagagcgagacuccaucucaaaa

SEQ ID NO: 1384810 - RNA, 21 nt, Human
acaggguuucaccauguuggu

SEQ ID NO: 1384811 - RNA, 23 nt, Human
acaggguuucaccauguugguca

SEQ ID NO: 1384812 - RNA, 24 nt, Human
acaggguuucaccauguuggucag

SEQ ID NO: 1384813 - RNA, 23 nt, Human
accauguuggucaggcuggucuc

SEQ ID NO: 1384814 - RNA, 25 nt, Human
acccgccuuggccucccaaagugcu

SEQ ID NO: 1384815 - RNA, 24 nt, Human
acccggcugauuuuuguauuuuua

SEQ ID NO: 1384816 - RNA, 24 nt, Human
accuugugauccaccugccucagc

SEQ ID NO: 1384817 - RNA, 19 nt, Human
acgggguuuugccaugugg

SEQ ID NO: 1384818 - RNA, 23 nt, Human
acgggguuuugccauguggccag

SEQ ID NO: 1384819 - RNA, 19 nt, Human
acuacaggugcaugccacc

SEQ ID NO: 1384820 - RNA, 23 nt, Human
acugcccuccagccuggugacag

SEQ ID NO: 1384821 - RNA, 25 nt, Human
acugcccuccagccuggugacagag

SEQ ID NO: 1384822 - RNA, 18 nt, Human
acugcccuuuuuuuuuuu

SEQ ID NO: 1384823 - RNA, 18 nt, Human
acuuagugacucagacua

SEQ ID NO: 1384824 - RNA, 19 nt, Human
agaacaaaaccccccaaac

SEQ ID NO: 1384825 - RNA, 21 nt, Human
agauacaaacauucagucugc

SEQ ID NO: 1384826 - RNA, 22 nt, Human
agcacagaacaaaaccccccaa

SEQ ID NO: 1384827 - RNA, 21 nt, Human
agccuggugacagagcgagac

SEQ ID NO: 1384828 - RNA, 23 nt, Human
agccuggugacagagcgagacuc

SEQ ID NO: 1384829 - RNA, 27 nt, Human
agcuagaguucuagcagaaguugccug

SEQ ID NO: 1384830 - RNA, 23 nt, Human
agcuggauacaguggugcgauca

SEQ ID NO: 1384831 - RNA, 23 nt, Human
agcugggcaugguggcaugugcu

SEQ ID NO: 1384832 - RNA, 21 nt, Human
agcuucaagugauucuccugc

SEQ ID NO: 1384833 - RNA, 22 nt, Human
agcuucaagugauucuccugcc

SEQ ID NO: 1384834 - RNA, 26 nt, Human
aggaagauuugaagauuugaaggcug

SEQ ID NO: 1384835 - RNA, 22 nt, Human
aggacacagugaggccagcuug

SEQ ID NO: 1384836 - RNA, 24 nt, Human
aggcaggagaaucgcuugaacccg

SEQ ID NO: 1384837 - RNA, 24 nt, Human
aggcggagguugcagugagcugag

SEQ ID NO: 1384838 - RNA, 20 nt, Human
aggcugaggcaggagaaucg

SEQ ID NO: 1384839 - RNA, 24 nt, Human
aggcugaggcaggagaaucgcuug

SEQ ID NO: 1384840 - RNA, 24 nt, Human
aggguauccacccgccuuggccuc

SEQ ID NO: 1384841 - RNA, 25 nt, Human
aggugcuggcaaauuccauucugcu

SEQ ID NO: 1384842 - RNA, 23 nt, Human
aggugugagccaccgugccuggc

SEQ ID NO: 1384843 - RNA, 24 nt, Human
agguuguuuccaaucuguagcuau

SEQ ID NO: 1384844 - RNA, 22 nt, Human
aguagagacaggguuucaccau

SEQ ID NO: 1384845 - RNA, 18 nt, Human
aguagcugggacuacagg

SEQ ID NO: 1384846 - RNA, 18 nt, Human
aguagcugggauuacagg

SEQ ID NO: 1384847 - RNA, 26 nt, Human
agucaucagcucacccaagauucaga

SEQ ID NO: 1384848 - RNA, 24 nt, Human
agugauucuccugccucagccucc

SEQ ID NO: 1384849 - RNA, 21 nt, Human
auccacccgccuuggccuccc

SEQ ID NO: 1384850 - RNA, 24 nt, Human
aucgcaccacugcccuccagccug

SEQ ID NO: 1384851 - RNA, 20 nt, Human
auguacauaacucgucuucc

SEQ ID NO: 1384852 - RNA, 18 nt, Human
auucuccugccucagccu

SEQ ID NO: 1384853 - RNA, 20 nt, Human
auuuuuguauuuuuaguaga

SEQ ID NO: 1384854 - RNA, 22 nt, Human
auuuuuguauuuuuaguagaga

SEQ ID NO: 1384855 - RNA, 22 nt, Human
auuuuuguauuuuuaguagaga

SEQ ID NO: 1384856 - RNA, 24 nt, Human
auuuuuguauuuuuaguagagaca

SEQ ID NO: 1384857 - RNA, 21 nt, Human
caaaaaaaaauuagcugggca

SEQ ID NO: 1384858 - RNA, 23 nt, Human
caaacuccugaccuugugaucca

SEQ ID NO: 1384859 - RNA, 24 nt, Human
caaagugcugggauuacaggugug

SEQ ID NO: 1384860 - RNA, 23 nt, Human
caaauggcacagagaagaagcug

SEQ ID NO: 1384861 - RNA, 27 nt, Human
caagcgauccucccaucuuggccuccc

SEQ ID NO: 1384862 - RNA, 21 nt, Human
caagggccugacuucuggugu

SEQ ID NO: 1384863 - RNA, 22 nt, Human
caagugauucuccugccucagc

SEQ ID NO: 1384864 - RNA, 22 nt, Human
cacagaacaaaaccccccaaac

SEQ ID NO: 1384865 - RNA, 24 nt, Human
caccacacccggcugauuuuugua

SEQ ID NO: 1384866 - RNA, 21 nt, Human
caccauguuggucaggcuggu

SEQ ID NO: 1384867 - RNA, 24 nt, Human
caccauguuggucaggcuggucuc

SEQ ID NO: 1384868 - RNA, 23 nt, Human
cacccgccuuggccucccaaagu

SEQ ID NO: 1384869 - RNA, 24 nt, Human
cacccgccuuggccucccaaagug

SEQ ID NO: 1384870 - RNA, 23 nt, Human
caccugccucagccucccaaagu

SEQ ID NO: 1384871 - RNA, 21 nt, Human
cacugcaaccuccgccuccca

SEQ ID NO: 1384872 - RNA, 21 nt, Human
cacugcaaccucugccucccg

SEQ ID NO: 1384873 - RNA, 23 nt, Human
cacugcaaccucugccucccggg

SEQ ID NO: 1384874 - RNA, 23 nt, Human
cacugcccuccagccuggugaca

SEQ ID NO: 1384875 - RNA, 23 nt, Human
cacugcccuccagccuggugaca

SEQ ID NO: 1384876 - RNA, 26 nt, Human
cacugcccuuuuuuuuuuuuuuuuuu

SEQ ID NO: 1384877 - RNA, 21 nt, Human
cagaacaaaaccccccaaacc

SEQ ID NO: 1384878 - RNA, 22 nt, Human
cagaacaaaaccccccaaaccu

SEQ ID NO: 1384879 - RNA, 21 nt, Human
cagagaagaagcaagcucuca

SEQ ID NO: 1384880 - RNA, 21 nt, Human
cagagggcuucguuagagcuc

SEQ ID NO: 1384881 - RNA, 23 nt, Human
cagcauggcagccucuaagcaga

SEQ ID NO: 1384882 - RNA, 20 nt, Human
cagcuucaagugauucuccu

SEQ ID NO: 1384883 - RNA, 21 nt, Human
caggcaggacacagugaggcc

SEQ ID NO: 1384884 - RNA, 22 nt, Human
caggcaggacacagugaggcca

SEQ ID NO: 1384885 - RNA, 24 nt, Human
caggguuucaccauguuggucagg

SEQ ID NO: 1384886 - RNA, 19 nt, Human
caguggcacgaucuuggcu

SEQ ID NO: 1384887 - RNA, 24 nt, Human
caugccaccacacccggcugauuu

SEQ ID NO: 1384888 - RNA, 19 nt, Human
ccaaagugcuaggauuaca

SEQ ID NO: 1384889 - RNA, 21 nt, Human
ccaaagugcugggauuacagg

SEQ ID NO: 1384890 - RNA, 21 nt, Human
ccaaagugcugggauuacagg

SEQ ID NO: 1384891 - RNA, 24 nt, Human
ccaaagugcugggauuacaggugu

SEQ ID NO: 1384892 - RNA, 22 nt, Human
ccaccacagguuguuuccaauc

SEQ ID NO: 1384893 - RNA, 19 nt, Human
ccaccugccucagccuccc

SEQ ID NO: 1384894 - RNA, 19 nt, Human
ccacugcccuccagccugg

SEQ ID NO: 1384895 - RNA, 19 nt, Human
ccacugcccuccagccugg

SEQ ID NO: 1384896 - RNA, 20 nt, Human
ccacugcccuccagccuggu

SEQ ID NO: 1384897 - RNA, 23 nt, Human
ccacugcccuccagccuggugac

SEQ ID NO: 1384898 - RNA, 23 nt, Human
ccacuuccaaauaacaucaccuu

SEQ ID NO: 1384899 - RNA, 19 nt, Human
ccagcuuguuucuacucug

SEQ ID NO: 1384900 - RNA, 24 nt, Human
ccaucucaaaaaaaaaaaaaaaaa

SEQ ID NO: 1384901 - RNA, 18 nt, Human
ccauguggccaggcuggu

SEQ ID NO: 1384902 - RNA, 22 nt, Human
ccauguggccaggcuggucucg

SEQ ID NO: 1384903 - RNA, 19 nt, Human
cccaccucucuacagagga

SEQ ID NO: 1384904 - RNA, 18 nt, Human
cccacugaguaacagagu

SEQ ID NO: 1384905 - RNA, 21 nt, Human
cccacuuccaaauaacaucac

SEQ ID NO: 1384906 - RNA, 20 nt, Human
cccaggcuacggugcagugg

SEQ ID NO: 1384907 - RNA, 24 nt, Human
cccccaaggcaucuacuguuaccu

SEQ ID NO: 1384908 - RNA, 23 nt, Human
cccggguucaagcaauucuccug

SEQ ID NO: 1384909 - RNA, 23 nt, Human
cccuaguagcugggauuacaggu

SEQ ID NO: 1384910 - RNA, 24 nt, Human
cccuaguagcugggauuacaggug

SEQ ID NO: 1384911 - RNA, 24 nt, Human
ccgccucccagcuucaagugauuc

SEQ ID NO: 1384912 - RNA, 22 nt, Human
ccggaguagcugggacuacagg

SEQ ID NO: 1384913 - RNA, 23 nt, Human
ccuaguagcugggauuacaggug

SEQ ID NO: 1384914 - RNA, 19 nt, Human
ccucauccucccuaguagc

SEQ ID NO: 1384915 - RNA, 24 nt, Human
ccucccagcuucaagugauucucc

SEQ ID NO: 1384916 - RNA, 26 nt, Human
ccucccaucuuggccucccaaagugc

SEQ ID NO: 1384917 - RNA, 24 nt, Human
ccucccggguucaagcaauucucc

SEQ ID NO: 1384918 - RNA, 22 nt, Human
ccucuaagcagacauggagccc

SEQ ID NO: 1384919 - RNA, 24 nt, Human
ccucuuucuugucuauuuucccaa

SEQ ID NO: 1384920 - RNA, 19 nt, Human
ccugaccuugugauccacc

SEQ ID NO: 1384921 - RNA, 21 nt, Human
ccugaccuugugauccaccug

SEQ ID NO: 1384922 - RNA, 20 nt, Human
ccugggcucaagcgauccuc

SEQ ID NO: 1384923 - RNA, 21 nt, Human
ccuggugacagagcgagacuc

SEQ ID NO: 1384924 - RNA, 24 nt, Human
ccuguguugaccaagcuggucucg

SEQ ID NO: 1384925 - RNA, 21 nt, Human
ccuugccaucaguuacccucc

SEQ ID NO: 1384926 - RNA, 24 nt, Human
ccuugccaucaguuacccuccccc

SEQ ID NO: 1384927 - RNA, 23 nt, Human
cgagacuccaucucaaaaaaaaa

SEQ ID NO: 1384928 - RNA, 25 nt, Human
cgagcuccugggcucaagcgauccu

SEQ ID NO: 1384929 - RNA, 19 nt, Human
cgccaccaugcccggcuau

SEQ ID NO: 1384930 - RNA, 24 nt, Human
cgggaggcggagguugcagugagc

SEQ ID NO: 1384931 - RNA, 23 nt, Human
cgggguuuugccauguggccagg

SEQ ID NO: 1384932 - RNA, 20 nt, Human
cuaguagcugggauuacagg

SEQ ID NO: 1384933 - RNA, 18 nt, Human
cucaaaaaaaaaaaaaaa

SEQ ID NO: 1384934 - RNA, 24 nt, Human
cucaagcgauccucccaucuuggc

SEQ ID NO: 1384935 - RNA, 24 nt, Human
cucacugcaaccuccgccucccag

SEQ ID NO: 1384936 - RNA, 24 nt, Human
cucacugcaaccucugccucccgg

SEQ ID NO: 1384937 - RNA, 24 nt, Human
cucagccuccggaguagcugggac

SEQ ID NO: 1384938 - RNA, 24 nt, Human
cucaggguauccacccgccuuggc

SEQ ID NO: 1384939 - RNA, 24 nt, Human
cuccagccuggugacagagcgaga

SEQ ID NO: 1384940 - RNA, 19 nt, Human
cuccaucucaaaaaaaaaa

SEQ ID NO: 1384941 - RNA, 19 nt, Human
cucccagcuucaagugauu

SEQ ID NO: 1384942 - RNA, 24 nt, Human
cuccugaccuugugauccaccugc

SEQ ID NO: 1384943 - RNA, 25 nt, Human
cuccugggcucaagcgauccuccca

SEQ ID NO: 1384944 - RNA, 25 nt, Human
cugaguaacagagucuguuucuucc

SEQ ID NO: 1384945 - RNA, 23 nt, Human
cugauuuuuguauuuuuaguaga

SEQ ID NO: 1384946 - RNA, 19 nt, Human
cugcaaccucugccucccg

SEQ ID NO: 1384947 - RNA, 23 nt, Human
cugcaaccucugccucccggguu

SEQ ID NO: 1384948 - RNA, 24 nt, Human
cugcaaccucugccucccggguuc

SEQ ID NO: 1384949 - RNA, 23 nt, Human
cugccucagccuccggaguagcu

SEQ ID NO: 1384950 - RNA, 25 nt, Human
cugccucauccucccuaguagcugg

SEQ ID NO: 1384951 - RNA, 19 nt, Human
cuggcaaccaagggccuga

SEQ ID NO: 1384952 - RNA, 21 nt, Human
cuggcaaccaagggccugacu

SEQ ID NO: 1384953 - RNA, 22 nt, Human
cuucaagugauucuccugccuc

SEQ ID NO: 1384954 - RNA, 21 nt, Human
cuuccccuuccccuucgccuu

SEQ ID NO: 1384955 - RNA, 22 nt, Human
cuuguagucccagcuacugggg

SEQ ID NO: 1384956 - RNA, 22 nt, Human
cuuuuaugcuugaacugggaug

SEQ ID NO: 1384957 - RNA, 24 nt, Human
gaacucaggguauccacccgccuu

SEQ ID NO: 1384958 - RNA, 20 nt, Human
gaagaagcaagcucucaagg

SEQ ID NO: 1384959 - RNA, 22 nt, Human
gaccuugugauccaccugccuc

SEQ ID NO: 1384960 - RNA, 24 nt, Human
gaccuugugauccaccugccucag

SEQ ID NO: 1384961 - RNA, 23 nt, Human
gagaaucgcuugaacccgggagg

SEQ ID NO: 1384962 - RNA, 22 nt, Human
gagacgggguuuugccaugugg

SEQ ID NO: 1384963 - RNA, 23 nt, Human
gagguugcagugagcugagaucg

SEQ ID NO: 1384964 - RNA, 26 nt, Human
gaguagcugggacuacaggugcaugc

SEQ ID NO: 1384965 - RNA, 18 nt, Human
gauuacagacuucagcca

SEQ ID NO: 1384966 - RNA, 18 nt, Human
gauuacaggugcacgcca

SEQ ID NO: 1384967 - RNA, 22 nt, Human
gauuacaggugcacgccaccau

SEQ ID NO: 1384968 - RNA, 18 nt, Human
gauuacaggugugagcca

SEQ ID NO: 1384969 - RNA, 20 nt, Human
gauuacaggugugagccacc

SEQ ID NO: 1384970 - RNA, 21 nt, Human
gauuacaggugugagccaccg

SEQ ID NO: 1384971 - RNA, 22 nt, Human
gcaaccuccgccucccagcuuc

SEQ ID NO: 1384972 - RNA, 22 nt, Human
gcacagaacaaaaccccccaaa

SEQ ID NO: 1384973 - RNA, 19 nt, Human
gccauguggccaggcuggu

SEQ ID NO: 1384974 - RNA, 20 nt, Human
gccucagccuccggaguagc

SEQ ID NO: 1384975 - RNA, 22 nt, Human
gccuuggccucccaaagugcug

SEQ ID NO: 1384976 - RNA, 18 nt, Human
ggacacagugaggccagc

SEQ ID NO: 1384977 - RNA, 22 nt, Human
ggagcagguggcuugacaacac

SEQ ID NO: 1384978 - RNA, 22 nt, Human
ggagguugcagugagcugagau

SEQ ID NO: 1384979 - RNA, 23 nt, Human
ggagguugcagugagcugagauc

SEQ ID NO: 1384980 - RNA, 24 nt, Human
ggagguugcagugagcugagaucg

SEQ ID NO: 1384981 - RNA, 21 nt, Human
ggcacagagaagaagcaagcu

SEQ ID NO: 1384982 - RNA, 24 nt, Human
ggcuggucucaaacuccugaccuu

SEQ ID NO: 1384983 - RNA, 22 nt, Human
gggaggcugaggcaggagaauc

SEQ ID NO: 1384984 - RNA, 22 nt, Human
gggguuuugccauguggccagg

SEQ ID NO: 1384985 - RNA, 22 nt, Human
ggguuucaccauguuggucagg

SEQ ID NO: 1384986 - RNA, 21 nt, Human
ggguuuugccauguggccagg

SEQ ID NO: 1384987 - RNA, 20 nt, Human
ggucucaaacuccugaccuu

SEQ ID NO: 1384988 - RNA, 20 nt, Human
ggugcaguggcacgaucuug

SEQ ID NO: 1384989 - RNA, 24 nt, Human
ggugcaguggcacgaucuuggcuc

SEQ ID NO: 1384990 - RNA, 23 nt, Human
guagagacgggguuuugccaugu

SEQ ID NO: 1384991 - RNA, 18 nt, Human
guagcugggauuacaggu

SEQ ID NO: 1384992 - RNA, 21 nt, Human
gugaggccagcuuguuucuac

SEQ ID NO: 1384993 - RNA, 18 nt, Human
gugauccaccugccucag

SEQ ID NO: 1384994 - RNA, 24 nt, Human
gugauccaccugccucagccuccc

SEQ ID NO: 1384995 - RNA, 21 nt, Human
gugauucuccugccucagccu

SEQ ID NO: 1384996 - RNA, 20 nt, Human
gugcaguggcacgaucuugg

SEQ ID NO: 1384997 - RNA, 22 nt, Human
gugcaguggcacgaucuuggcu

SEQ ID NO: 1384998 - RNA, 23 nt, Human
gugcaguggcacgaucuuggcuc

SEQ ID NO: 1384999 - RNA, 21 nt, Human
gugcgugccaccaugcucagc

SEQ ID NO: 1385000 - RNA, 18 nt, Human
gugucaggaauucaggca

SEQ ID NO: 1385001 - RNA, 21 nt, Human
guugcagugagcugagaucgc

SEQ ID NO: 1385002 - RNA, 23 nt, Human
uaacaucaccuuaggacuucaac

SEQ ID NO: 1385003 - RNA, 23 nt, Human
uacaggugcaugccaccacaccc

SEQ ID NO: 1385004 - RNA, 22 nt, Human
uacaggugugagccaccgugcc

SEQ ID NO: 1385005 - RNA, 22 nt, Human
uacaggugugagccaccgugcc

SEQ ID NO: 1385006 - RNA, 23 nt, Human
uacaggugugagccaccgugccu

SEQ ID NO: 1385007 - RNA, 24 nt, Human
uacggugcaguggcacgaucuugg

SEQ ID NO: 1385008 - RNA, 22 nt, Human
uagagacaggguuucaccaugu

SEQ ID NO: 1385009 - RNA, 22 nt, Human
uagagacgggguuuugccaugu

SEQ ID NO: 1385010 - RNA, 21 nt, Human
uagcacagaacaaaacccccc

SEQ ID NO: 1385011 - RNA, 22 nt, Human
uagcugggcaugguggcaugug

SEQ ID NO: 1385012 - RNA, 21 nt, Human
uaggauuacagacuucagcca

SEQ ID NO: 1385013 - RNA, 21 nt, Human
uaggauuacagacuucagcca

SEQ ID NO: 1385014 - RNA, 22 nt, Human
uaggauuacagacuucagccau

SEQ ID NO: 1385015 - RNA, 24 nt, Human
uaguagagacaggguuucaccaug

SEQ ID NO: 1385016 - RNA, 26 nt, Human
uaguagagacaggguuucaccauguu

SEQ ID NO: 1385017 - RNA, 24 nt, Human
uaguagagacgggguuuugccaug

SEQ ID NO: 1385018 - RNA, 26 nt, Human
uaguagcugggauuacaggugcacgc

SEQ ID NO: 1385019 - RNA, 26 nt, Human
ucaaagcuaagcuuagcugggacugu

SEQ ID NO: 1385020 - RNA, 18 nt, Human
ucaagugauucuccugcc

SEQ ID NO: 1385021 - RNA, 19 nt, Human
ucacugcaaccuccgccuc

SEQ ID NO: 1385022 - RNA, 23 nt, Human
ucacugcaaccuccgccucccag

SEQ ID NO: 1385023 - RNA, 24 nt, Human
ucacugcaaccuccgccucccagc

SEQ ID NO: 1385024 - RNA, 27 nt, Human
ucacugcaaccuccgccucccagcuuc

SEQ ID NO: 1385025 - RNA, 24 nt, Human
ucacugcaaccucugccucccggg

SEQ ID NO: 1385026 - RNA, 25 nt, Human
ucacugcaaccucugccucccgggu

SEQ ID NO: 1385027 - RNA, 19 nt, Human
ucaggcaggacacagugag

SEQ ID NO: 1385028 - RNA, 23 nt, Human
ucaggcaggacacagugaggcca

SEQ ID NO: 1385029 - RNA, 22 nt, Human
uccagccuggugacagagcgag

SEQ ID NO: 1385030 - RNA, 23 nt, Human
uccaucucaaaaaaaaaaaaaaa

SEQ ID NO: 1385031 - RNA, 19 nt, Human
uccauucugcuggcaacca

SEQ ID NO: 1385032 - RNA, 20 nt, Human
ucccaaaggcccacuuccaa

SEQ ID NO: 1385033 - RNA, 18 nt, Human
ucccaaagugcuaggauu

SEQ ID NO: 1385034 - RNA, 23 nt, Human
ucccaaagugcugggauuacagg

SEQ ID NO: 1385035 - RNA, 24 nt, Human
ucccagcuucaagugauucuccug

SEQ ID NO: 1385036 - RNA, 21 nt, Human
ucccggguucaagcaauucuc

SEQ ID NO: 1385037 - RNA, 24 nt, Human
ucccggguucaagcaauucuccug

SEQ ID NO: 1385038 - RNA, 24 nt, Human
ucccuaguagcugggauuacaggu

SEQ ID NO: 1385039 - RNA, 25 nt, Human
ucccucccaaaggcccacuuccaaa

SEQ ID NO: 1385040 - RNA, 21 nt, Human
ucccuguguugaccaagcugg

SEQ ID NO: 1385041 - RNA, 24 nt, Human
uccggaguagcugggacuacaggu

SEQ ID NO: 1385042 - RNA, 21 nt, Human
uccugggcucaagcgauccuc

SEQ ID NO: 1385043 - RNA, 22 nt, Human
uccugggcucaagcgauccucc

SEQ ID NO: 1385044 - RNA, 23 nt, Human
ucgcaccacugcccuccagccug

SEQ ID NO: 1385045 - RNA, 24 nt, Human
ucgcuugaacccgggaggcggagg

SEQ ID NO: 1385046 - RNA, 20 nt, Human
ucuacucugcaauguuugag

SEQ ID NO: 1385047 - RNA, 27 nt, Human
ucucacucuuaucacccaggcuacggu

SEQ ID NO: 1385048 - RNA, 28 nt, Human
ucucacucuuaucacccaggcuacggug

SEQ ID NO: 1385049 - RNA, 23 nt, Human
ucucacuuuguugcccgagcugg

SEQ ID NO: 1385050 - RNA, 24 nt, Human
ucucacuuuguugcccgagcugga

SEQ ID NO: 1385051 - RNA, 24 nt, Human
ucuccugccucagccuccggagua

SEQ ID NO: 1385052 - RNA, 22 nt, Human
ucucgaacuccugaacucaggg

SEQ ID NO: 1385053 - RNA, 19 nt, Human
ucucgagcuccugggcuca

SEQ ID NO: 1385054 - RNA, 23 nt, Human
ucucgagcuccugggcucaagcg

SEQ ID NO: 1385055 - RNA, 24 nt, Human
ucugccucccggguucaagcaauu

SEQ ID NO: 1385056 - RNA, 21 nt, Human
ucugguucuucuucacucacu

SEQ ID NO: 1385057 - RNA, 22 nt, Human
ucuguuagcacagaacaaaacc

SEQ ID NO: 1385058 - RNA, 21 nt, Human
ucuuggccucccaaagugcua

SEQ ID NO: 1385059 - RNA, 19 nt, Human
ucuuguucuuccccuuccc

SEQ ID NO: 1385060 - RNA, 24 nt, Human
ugaagagucuaagaucaaggugcu

SEQ ID NO: 1385061 - RNA, 24 nt, Human
ugaccaagcuggucucgagcuccu

SEQ ID NO: 1385062 - RNA, 20 nt, Human
ugacucaaagcuaagcuuag

SEQ ID NO: 1385063 - RNA, 18 nt, Human
ugagacagagucucacuc

SEQ ID NO: 1385064 - RNA, 22 nt, Human
ugagcugagaucgcaccacugc

SEQ ID NO: 1385065 - RNA, 20 nt, Human
ugaggcaggagaaucgcuug

SEQ ID NO: 1385066 - RNA, 24 nt, Human
ugaggcaggagaaucgcuugaacc

SEQ ID NO: 1385067 - RNA, 25 nt, Human
ugaggcaggagaaucgcuugaaccc

SEQ ID NO: 1385068 - RNA, 22 nt, Human
ugaggccagcuuguuucuacuc

SEQ ID NO: 1385069 - RNA, 20 nt, Human
ugcaauggcaugaugucggc

SEQ ID NO: 1385070 - RNA, 24 nt, Human
ugccucagccuccggaguagcugg

SEQ ID NO: 1385071 - RNA, 18 nt, Human
ugccucaggcuccaagag

SEQ ID NO: 1385072 - RNA, 19 nt, Human
ugccucaggcuccaagagc

SEQ ID NO: 1385073 - RNA, 22 nt, Human
ugccucaggcuccaagagcuag

SEQ ID NO: 1385074 - RNA, 21 nt, Human
ugcgaucaggugcgugccacc

SEQ ID NO: 1385075 - RNA, 24 nt, Human
ugcugggauuacaggugugagcca

SEQ ID NO: 1385076 - RNA, 22 nt, Human
ugcuuguagucccagcuacugg

SEQ ID NO: 1385077 - RNA, 23 nt, Human
ugcuuguagucccagcuacuggg

SEQ ID NO: 1385078 - RNA, 20 nt, Human
uggcaugaugucggcucacu

SEQ ID NO: 1385079 - RNA, 20 nt, Human
uggcaugugcuuguaguccc

SEQ ID NO: 1385080 - RNA, 24 nt, Human
uggcaugugcuuguagucccagcu

SEQ ID NO: 1385081 - RNA, 24 nt, Human
uggccaggcuggucucgaacuccu

SEQ ID NO: 1385082 - RNA, 21 nt, Human
ugggacuacaggugcaugcca

SEQ ID NO: 1385083 - RNA, 22 nt, Human
ugggacuacaggugcaugccac

SEQ ID NO: 1385084 - RNA, 24 nt, Human
ugggacuacaggugcaugccacca

SEQ ID NO: 1385085 - RNA, 22 nt, Human
ugggauuacaggugcacgccac

SEQ ID NO: 1385086 - RNA, 24 nt, Human
ugggauuacaggugcacgccacca

SEQ ID NO: 1385087 - RNA, 25 nt, Human
ugggauuacaggugcacgccaccau

SEQ ID NO: 1385088 - RNA, 18 nt, Human
ugggauuacaggugugag

SEQ ID NO: 1385089 - RNA, 21 nt, Human
ugggauuacaggugugagcca

SEQ ID NO: 1385090 - RNA, 22 nt, Human
ugggauuacaggugugagccac

SEQ ID NO: 1385091 - RNA, 23 nt, Human
ugggauuacaggugugagccacc

SEQ ID NO: 1385092 - RNA, 23 nt, Human
ugggauuacaggugugagccacc

SEQ ID NO: 1385093 - RNA, 24 nt, Human
ugggauuacaggugugagccaccg

SEQ ID NO: 1385094 - RNA, 20 nt, Human
ugggcaugguggcaugugcu

SEQ ID NO: 1385095 - RNA, 24 nt, Human
uggucaggcuggucucaaacuccu

SEQ ID NO: 1385096 - RNA, 24 nt, Human
ugguggcaugugcuuguaguccca

SEQ ID NO: 1385097 - RNA, 21 nt, Human
uguauuuuuaguagagacggg

SEQ ID NO: 1385098 - RNA, 19 nt, Human
ugucaggaauucaggcagg

SEQ ID NO: 1385099 - RNA, 19 nt, Human
ugucuauuuucccagaagu

SEQ ID NO: 1385100 - RNA, 22 nt, Human
ugucuauuuucccagaaguucu

SEQ ID NO: 1385101 - RNA, 25 nt, Human
ugugagccaccgugccuggccucau

SEQ ID NO: 1385102 - RNA, 24 nt, Human
ugugauccaccugccucagccucc

SEQ ID NO: 1385103 - RNA, 18 nt, Human
ugugucaggaauucaggc

SEQ ID NO: 1385104 - RNA, 21 nt, Human
uuagagcucugaccugagcac

SEQ ID NO: 1385105 - RNA, 19 nt, Human
uuagcugggcaugguggca

SEQ ID NO: 1385106 - RNA, 24 nt, Human
uuagcugggcaugguggcaugugc

SEQ ID NO: 1385107 - RNA, 24 nt, Human
uuaguagagacaggguuucaccau

SEQ ID NO: 1385108 - RNA, 18 nt, Human
uuaguagagacgggguuu

SEQ ID NO: 1385109 - RNA, 22 nt, Human
uuaguagagacgggguuuugcc

SEQ ID NO: 1385110 - RNA, 24 nt, Human
uuaguagagacgggguuuugccau

SEQ ID NO: 1385111 - RNA, 21 nt, Human
uucaagcaauucuccugccuc

SEQ ID NO: 1385112 - RNA, 23 nt, Human
uucaagcaauucuccugccucau

SEQ ID NO: 1385113 - RNA, 21 nt, Human
uucaagugauucuccugccuc

SEQ ID NO: 1385114 - RNA, 23 nt, Human
uucaagugauucuccugccucag

SEQ ID NO: 1385115 - RNA, 24 nt, Human
uucaagugauucuccugccucagc

SEQ ID NO: 1385116 - RNA, 19 nt, Human
uucagagaggguacaagga

SEQ ID NO: 1385117 - RNA, 19 nt, Human
uuccucaggucugcagggu

SEQ ID NO: 1385118 - RNA, 22 nt, Human
uuccucaggucugcagggugaa

SEQ ID NO: 1385119 - RNA, 24 nt, Human
uugaacccgggaggcggagguugc

SEQ ID NO: 1385120 - RNA, 23 nt, Human
uugagacagagucucacucuuau

SEQ ID NO: 1385121 - RNA, 18 nt, Human
uugcagugagcugagauc

SEQ ID NO: 1385122 - RNA, 19 nt, Human
uugcagugagcugagaucg

SEQ ID NO: 1385123 - RNA, 22 nt, Human
uugcagugagcugagaucgcac

SEQ ID NO: 1385124 - RNA, 24 nt, Human
uugccaucaguuacccucccccaa

SEQ ID NO: 1385125 - RNA, 24 nt, Human
uugccauguggccaggcuggucuc

SEQ ID NO: 1385126 - RNA, 22 nt, Human
uugccuguacuuuuaugucugg

SEQ ID NO: 1385127 - RNA, 18 nt, Human
uuggccucccaaagugcu

SEQ ID NO: 1385128 - RNA, 23 nt, Human
uuguauuuuuaguagagacgggg

SEQ ID NO: 1385129 - RNA, 24 nt, Human
uuucaccauguuggucaggcuggu

SEQ ID NO: 1385130 - RNA, 22 nt, Human
uuugagaauuucaaauggaggc

SEQ ID NO: 1385131 - RNA, 21 nt, Human
uuuuguauuuuuaguagagac

SEQ ID NO: 1385132 - RNA, 24 nt, Human
uuuuuaguagagacaggguuucac

SEQ ID NO: 1385133 - RNA, 21 nt, Human
uuuuuaguagagacgggguuu

SEQ ID NO: 1385134 - RNA, 24 nt, Human
uuuuuaguagagacgggguuuugc

SEQ ID NO: 1385135 - RNA, 20 nt, Human
uuuuuguauuuuuaguagag

SEQ ID NO: 1385136 - RNA, 20 nt, Human
uuuuuguauuuuuaguagag

SEQ ID NO: 1385137 - RNA, 26 nt, Human
uuuuuuuuuuuugagacagagucuca

SEQ ID NO: 1385138 - RNA, 18 nt, Human
uuuuuuuuuuuuuuuuug

SEQ ID NO: 1385139 - RNA, 19 nt, Human
aggcaaaacuguucccuga

SEQ ID NO: 1385140 - RNA, 22 nt, Human
auccacuguagccucuugucau

SEQ ID NO: 1385141 - RNA, 21 nt, Human
caagauguacagcaagaccug

SEQ ID NO: 1385142 - RNA, 25 nt, Human
cauucugaacucucaugugugucuu

SEQ ID NO: 1385143 - RNA, 20 nt, Human
cccugaagaccucuccacaa

SEQ ID NO: 1385144 - RNA, 29 nt, Human
cugauggugugaugaugugcaucccuucc

SEQ ID NO: 1385145 - RNA, 23 nt, Human
gaucaccucaggccagcuuauga

SEQ ID NO: 1385146 - RNA, 22 nt, Human
gucacagaguuuccauccacug

SEQ ID NO: 1385147 - RNA, 19 nt, Human
gugaugaugugcaucccuu

SEQ ID NO: 1385148 - RNA, 21 nt, Human
gugcaucccuuccuugaugcc

SEQ ID NO: 1385149 - RNA, 18 nt, Human
ugagaacuucaagaugua

SEQ ID NO: 1385150 - RNA, 19 nt, Human
ugcacacugagggugucuu

SEQ ID NO: 1385151 - RNA, 23 nt, Human
uggugugaugaugugcaucccuu

SEQ ID NO: 1385152 - RNA, 23 nt, Human
uuaaauuuggaaaguuccugucc

SEQ ID NO: 1385153 - RNA, 19 nt, Human
uucccugaagaccucucca

SEQ ID NO: 1385154 - RNA, 24 nt, Human
uuccugaaauucacagaguuucuc

SEQ ID NO: 1385155 - RNA, 24 nt, Human
uugaugccaagaucaccucaggcc

SEQ ID NO: 1385156 - RNA, 23 nt, Human
aaacaaauguuucucaacgagcu

SEQ ID NO: 1385157 - RNA, 23 nt, Human
aaaggugcaacgagaaccaaguc

SEQ ID NO: 1385158 - RNA, 18 nt, Human
aaccagucaauccguuaa

SEQ ID NO: 1385159 - RNA, 18 nt, Human
acaaagcaaaauacaugg

SEQ ID NO: 1385160 - RNA, 25 nt, Human
acaaagcaaaauacauggugggacu

SEQ ID NO: 1385161 - RNA, 20 nt, Human
agcgaaggcucucacucugc

SEQ ID NO: 1385162 - RNA, 19 nt, Human
agcggaagcgcggggcgcc

SEQ ID NO: 1385163 - RNA, 23 nt, Human
aggcacgaccacaguagccgcac

SEQ ID NO: 1385164 - RNA, 20 nt, Human
agggugguggccccggcaaa

SEQ ID NO: 1385165 - RNA, 19 nt, Human
aguuauuggcuugcacuca

SEQ ID NO: 1385166 - RNA, 22 nt, Human
auggaagacauggaaaugggau

SEQ ID NO: 1385167 - RNA, 23 nt, Human
auuuucuuccuuuuccagacucu

SEQ ID NO: 1385168 - RNA, 23 nt, Human
caauaucucuuaacaucuuacuu

SEQ ID NO: 1385169 - RNA, 23 nt, Human
cacaguagccgcacuugaaaggc

SEQ ID NO: 1385170 - RNA, 20 nt, Human
caccaccgcacuugacgggc

SEQ ID NO: 1385171 - RNA, 19 nt, Human
caccggcagcugcgacacc

SEQ ID NO: 1385172 - RNA, 26 nt, Human
cagcggaagcgcggggcgccgcgacc

SEQ ID NO: 1385173 - RNA, 20 nt, Human
cagggccgagagaccagcca

SEQ ID NO: 1385174 - RNA, 22 nt, Human
cagguaauaguccagcuccucu

SEQ ID NO: 1385175 - RNA, 20 nt, Human
caguggguccccaugaaaca

SEQ ID NO: 1385176 - RNA, 18 nt, Human
ccccugagcagcgcggga

SEQ ID NO: 1385177 - RNA, 21 nt, Human
ccccugagcagcgcgggagga

SEQ ID NO: 1385178 - RNA, 23 nt, Human
cccgccgccgccgccaccaccac

SEQ ID NO: 1385179 - RNA, 19 nt, Human
cccggcaaaggcacgacca

SEQ ID NO: 1385180 - RNA, 20 nt, Human
cccggcaaaggcacgaccac

SEQ ID NO: 1385181 - RNA, 26 nt, Human
cccggggccggagguggcgccgaggc

SEQ ID NO: 1385182 - RNA, 23 nt, Human
ccgcccggaaaccucccgaccug

SEQ ID NO: 1385183 - RNA, 28 nt, Human
ccgccgccaccaccaccgcacuugacgg

SEQ ID NO: 1385184 - RNA, 21 nt, Human
ccugcaucaagaccgggcugu

SEQ ID NO: 1385185 - RNA, 19 nt, Human
cgaacaccggcagcugcga

SEQ ID NO: 1385186 - RNA, 22 nt, Human
cgcgaacaccggcagcugcgac

SEQ ID NO: 1385187 - RNA, 21 nt, Human
cggaaaccucccgaccugcaa

SEQ ID NO: 1385188 - RNA, 27 nt, Human
cggcucggcggcgacggcagcggcggg

SEQ ID NO: 1385189 - RNA, 22 nt, Human
cggugggcagaagaacccauac

SEQ ID NO: 1385190 - RNA, 18 nt, Human
cuccccgccgccgccgcc

SEQ ID NO: 1385191 - RNA, 24 nt, Human
cuccccgccgccgccgccaccacc

SEQ ID NO: 1385192 - RNA, 18 nt, Human
cugcgacaccggcagggc

SEQ ID NO: 1385193 - RNA, 18 nt, Human
cuggcagcuucccggcug

SEQ ID NO: 1385194 - RNA, 22 nt, Human
cuggcuccuugguuccacgcuc

SEQ ID NO: 1385195 - RNA, 20 nt, Human
cuggggcagccagugucagg

SEQ ID NO: 1385196 - RNA, 26 nt, Human
gaagcuccucucacaccucucgcacu

SEQ ID NO: 1385197 - RNA, 24 nt, Human
gacaccggcagggccgagagacca

SEQ ID NO: 1385198 - RNA, 20 nt, Human
gaccacaguagccgcacuug

SEQ ID NO: 1385199 - RNA, 24 nt, Human
gacuggaaauguuaaccaucccag

SEQ ID NO: 1385200 - RNA, 21 nt, Human
gcaaaggcacgaccacaguag

SEQ ID NO: 1385201 - RNA, 19 nt, Human
gcacuugaaaggccgguca

SEQ ID NO: 1385202 - RNA, 19 nt, Human
gcccgcggagggcgcgaga

SEQ ID NO: 1385203 - RNA, 18 nt, Human
gcccggaaaccucccgac

SEQ ID NO: 1385204 - RNA, 22 nt, Human
gccugcgugaagcuccucucac

SEQ ID NO: 1385205 - RNA, 25 nt, Human
gcgaacaccggcagcugcgacaccg

SEQ ID NO: 1385206 - RNA, 22 nt, Human
gcgacggcagcggcggcuagag

SEQ ID NO: 1385207 - RNA, 19 nt, Human
ggcggcgacggcagcggcg

SEQ ID NO: 1385208 - RNA, 19 nt, Human
gggggcagcggcucggcgg

SEQ ID NO: 1385209 - RNA, 21 nt, Human
ggucugacuuccaugccagga

SEQ ID NO: 1385210 - RNA, 21 nt, Human
ggugucggcucagcugggugg

SEQ ID NO: 1385211 - RNA, 20 nt, Human
gugugugugugugugugugu

SEQ ID NO: 1385212 - RNA, 21 nt, Human
gugugugugugugugugugug

SEQ ID NO: 1385213 - RNA, 20 nt, Human
uaaaaagugcaugagcagug

SEQ ID NO: 1385214 - RNA, 23 nt, Human
uagaaacaaagcaaaauacaugg

SEQ ID NO: 1385215 - RNA, 20 nt, Human
ucaggccaggccaaacugaa

SEQ ID NO: 1385216 - RNA, 23 nt, Human
ucaggccaggccaaacugacaca

SEQ ID NO: 1385217 - RNA, 21 nt, Human
ucccugugcauucuuagucac

SEQ ID NO: 1385218 - RNA, 26 nt, Human
uccgcuggugucggcucagcugggug

SEQ ID NO: 1385219 - RNA, 24 nt, Human
uccgugguccccgcuggggcagcc

SEQ ID NO: 1385220 - RNA, 20 nt, Human
uccuagagauugugccgccc

SEQ ID NO: 1385221 - RNA, 22 nt, Human
uccucugcgcugcagcggaagc

SEQ ID NO: 1385222 - RNA, 19 nt, Human
uccuuggggggcagcggcu

SEQ ID NO: 1385223 - RNA, 22 nt, Human
uccuuggggggcagcggcucgg

SEQ ID NO: 1385224 - RNA, 25 nt, Human
ucggugagcgugcgggugcgcgaga

SEQ ID NO: 1385225 - RNA, 25 nt, Human
ucugcgcugcagcggaagcgcgggg

SEQ ID NO: 1385226 - RNA, 22 nt, Human
ucuuugguuuugcuuaaguguc

SEQ ID NO: 1385227 - RNA, 19 nt, Human
ugacacagcagaaugaagg

SEQ ID NO: 1385228 - RNA, 19 nt, Human
ugacuuccaugccaggauc

SEQ ID NO: 1385229 - RNA, 20 nt, Human
ugagcgugcgggugcgcgag

SEQ ID NO: 1385230 - RNA, 21 nt, Human
ugagcgugcgggugcgcgaga

SEQ ID NO: 1385231 - RNA, 25 nt, Human
ugagugugugugugugugugugugg

SEQ ID NO: 1385232 - RNA, 19 nt, Human
ugccaggaucaauaucucu

SEQ ID NO: 1385233 - RNA, 19 nt, Human
ugccccugagcagcgcggg

SEQ ID NO: 1385234 - RNA, 18 nt, Human
uggccgcugccgcguccu

SEQ ID NO: 1385235 - RNA, 20 nt, Human
uggcuccuugguuccacgcu

SEQ ID NO: 1385236 - RNA, 24 nt, Human
uggcuugcacucauugggcauccg

SEQ ID NO: 1385237 - RNA, 18 nt, Human
ugggaugcgucuggggcu

SEQ ID NO: 1385238 - RNA, 21 nt, Human
ugguuuugcuuaaguguccgu

SEQ ID NO: 1385239 - RNA, 23 nt, Human
uguacaguggguccccaugaaac

SEQ ID NO: 1385240 - RNA, 18 nt, Human
ugugugugugugugugug

SEQ ID NO: 1385241 - RNA, 18 nt, Human
ugugugugugugugugug

SEQ ID NO: 1385242 - RNA, 18 nt, Human
ugugugugugugugugug

SEQ ID NO: 1385243 - RNA, 18 nt, Human
ugugugugugugugugug

SEQ ID NO: 1385244 - RNA, 18 nt, Human
ugugugugugugugugug

SEQ ID NO: 1385245 - RNA, 18 nt, Human
ugugugugugugugugug

SEQ ID NO: 1385246 - RNA, 18 nt, Human
ugugugugugugugugug

SEQ ID NO: 1385247 - RNA, 18 nt, Human
ugugugugugugugugug

SEQ ID NO: 1385248 - RNA, 21 nt, Human
ugugugugugugugugugugu

SEQ ID NO: 1385249 - RNA, 21 nt, Human
ugugugugugugugugugugu

SEQ ID NO: 1385250 - RNA, 21 nt, Human
ugugugugugugugugugugu

SEQ ID NO: 1385251 - RNA, 21 nt, Human
ugugugugugugugugugugu

SEQ ID NO: 1385252 - RNA, 21 nt, Human
ugugugugugugugugugugu

SEQ ID NO: 1385253 - RNA, 21 nt, Human
ugugugugugugugugugugu

SEQ ID NO: 1385254 - RNA, 21 nt, Human
ugugugugugugugugugugu

SEQ ID NO: 1385255 - RNA, 21 nt, Human
ugugugugugugugugugugu

SEQ ID NO: 1385256 - RNA, 21 nt, Human
ugugugugugugugugugugu

SEQ ID NO: 1385257 - RNA, 21 nt, Human
ugugugugugugugugugugu

SEQ ID NO: 1385258 - RNA, 21 nt, Human
ugugugugugugugugugugu

SEQ ID NO: 1385259 - RNA, 21 nt, Human
ugugugugugugugugugugu

SEQ ID NO: 1385260 - RNA, 21 nt, Human
ugugugugugugugugugugu

SEQ ID NO: 1385261 - RNA, 21 nt, Human
ugugugugugugugugugugu

SEQ ID NO: 1385262 - RNA, 22 nt, Human
ugugugugugugugugugugug

SEQ ID NO: 1385263 - RNA, 22 nt, Human
ugugugugugugugugugugug

SEQ ID NO: 1385264 - RNA, 22 nt, Human
ugugugugugugugugugugug

SEQ ID NO: 1385265 - RNA, 22 nt, Human
ugugugugugugugugugugug

SEQ ID NO: 1385266 - RNA, 22 nt, Human
ugugugugugugugugugugug

SEQ ID NO: 1385267 - RNA, 22 nt, Human
ugugugugugugugugugugug

SEQ ID NO: 1385268 - RNA, 25 nt, Human
uguuacuaaaaaaaggugcaacgag

SEQ ID NO: 1385269 - RNA, 19 nt, Human
uguuucucaacgagcugcu

SEQ ID NO: 1385270 - RNA, 21 nt, Human
uuacugcuuuugguuuucugg

SEQ ID NO: 1385271 - RNA, 20 nt, Human
uuccagacucuccugcauca

SEQ ID NO: 1385272 - RNA, 24 nt, Human
uuccgugguccccgcuggggcagc

SEQ ID NO: 1385273 - RNA, 19 nt, Human
uugggcauccgcugguguc

SEQ ID NO: 1385274 - RNA, 20 nt, Human
uugguuuucugggacugauu

SEQ ID NO: 1385275 - RNA, 23 nt, Human
uuuccuggucugacuuccaugcc

SEQ ID NO: 1385276 - RNA, 18 nt, Human
uuugaaacugaaaccauu

SEQ ID NO: 1385277 - RNA, 22 nt, Human
aaaaaaaaaacacaaagauuug

SEQ ID NO: 1385278 - RNA, 23 nt, Human
aaaaaaaacaaaaaaaaaaacac

SEQ ID NO: 1385279 - RNA, 23 nt, Human
aaaacaaaaaaaaaaacacaaag

SEQ ID NO: 1385280 - RNA, 24 nt, Human
aaaacaaaaaaaaaaacacaaaga

SEQ ID NO: 1385281 - RNA, 21 nt, Human
aaacacaaagauuugcgagcu

SEQ ID NO: 1385282 - RNA, 24 nt, Human
aaagauuugcgagcucagagacaa

SEQ ID NO: 1385283 - RNA, 20 nt, Human
aaccccugcccguugcucuc

SEQ ID NO: 1385284 - RNA, 22 nt, Human
aaccugucccuucagcugggua

SEQ ID NO: 1385285 - RNA, 18 nt, Human
aacgugcugcccccaugg

SEQ ID NO: 1385286 - RNA, 21 nt, Human
aagcugggguccuuccccauu

SEQ ID NO: 1385287 - RNA, 24 nt, Human
accacauucagucauucuguggga

SEQ ID NO: 1385288 - RNA, 25 nt, Human
acucugucaccaaggcuggaagcga

SEQ ID NO: 1385289 - RNA, 19 nt, Human
agucauucuguggaguuuu

SEQ ID NO: 1385290 - RNA, 21 nt, Human
agugaugcuguggucuccagc

SEQ ID NO: 1385291 - RNA, 25 nt, Human
auagcccugcaauagugucaaagau

SEQ ID NO: 1385292 - RNA, 22 nt, Human
cacaaagauuugcgagcucaga

SEQ ID NO: 1385293 - RNA, 18 nt, Human
cacccucucuucccuccc

SEQ ID NO: 1385294 - RNA, 20 nt, Human
cacccucucuucccucccaa

SEQ ID NO: 1385295 - RNA, 20 nt, Human
cagcagcaauaggagaccaa

SEQ ID NO: 1385296 - RNA, 18 nt, Human
cagcuggguaaucucccu

SEQ ID NO: 1385297 - RNA, 23 nt, Human
cauagcccugcaauagugucaaa

SEQ ID NO: 1385298 - RNA, 24 nt, Human
caucauccgucaaccccugcccgu

SEQ ID NO: 1385299 - RNA, 24 nt, Human
ccacccucucuucccucccaaccu

SEQ ID NO: 1385300 - RNA, 24 nt, Human
ccagcuggccuccugaauggcuaa

SEQ ID NO: 1385301 - RNA, 22 nt, Human
ccauggcccaagccacccucuc

SEQ ID NO: 1385302 - RNA, 24 nt, Human
ccccauggcccaagccacccucuc

SEQ ID NO: 1385303 - RNA, 26 nt, Human
cccucucuucccucccaaccuguccc

SEQ ID NO: 1385304 - RNA, 25 nt, Human
ccgucucaaaaaaaaaaaaacaaaa

SEQ ID NO: 1385305 - RNA, 19 nt, Human
ccuccaugggaguagacuc

SEQ ID NO: 1385306 - RNA, 24 nt, Human
ccucuugugaaacaacaggguugg

SEQ ID NO: 1385307 - RNA, 24 nt, Human
ccuuccccauugccagcucugcag

SEQ ID NO: 1385308 - RNA, 23 nt, Human
cgacacuccgucucaaaaaaaaa

SEQ ID NO: 1385309 - RNA, 21 nt, Human
cgcacaagcuuguccaacccu

SEQ ID NO: 1385310 - RNA, 22 nt, Human
cgccugcaggcugaauguggcc

SEQ ID NO: 1385311 - RNA, 19 nt, Human
cuaccugauucucccuggc

SEQ ID NO: 1385312 - RNA, 18 nt, Human
cucaaaaaaaaaaaaaca

SEQ ID NO: 1385313 - RNA, 25 nt, Human
cucaaaaaaaaaaaaacaaaaaaaa

SEQ ID NO: 1385314 - RNA, 21 nt, Human
cucagcuuucuggccuugacc

SEQ ID NO: 1385315 - RNA, 18 nt, Human
cuccgccugcaggcugaa

SEQ ID NO: 1385316 - RNA, 23 nt, Human
cuccgucucaaaaaaaaaaaaac

SEQ ID NO: 1385317 - RNA, 22 nt, Human
cugaguuuaucugcgccacuug

SEQ ID NO: 1385318 - RNA, 22 nt, Human
cuugcuaaccucagagaauaaa

SEQ ID NO: 1385319 - RNA, 23 nt, Human
gaaacaacaggguagaacuuaag

SEQ ID NO: 1385320 - RNA, 21 nt, Human
gaaccacauucagucauucug

SEQ ID NO: 1385321 - RNA, 18 nt, Human
gaagcgacacuccgucuc

SEQ ID NO: 1385322 - RNA, 23 nt, Human
gcacaagcuuguccaacccuccg

SEQ ID NO: 1385323 - RNA, 21 nt, Human
gcccaacauaaauuuguaaac

SEQ ID NO: 1385324 - RNA, 19 nt, Human
gcuccugggguggcagcuc

SEQ ID NO: 1385325 - RNA, 20 nt, Human
gcucugcagcacugcccucc

SEQ ID NO: 1385326 - RNA, 21 nt, Human
gcucugcagcacugcccuccu

SEQ ID NO: 1385327 - RNA, 20 nt, Human
ggcuggaagcgacacuccgu

SEQ ID NO: 1385328 - RNA, 22 nt, Human
guggggccagagcacgccuucc

SEQ ID NO: 1385329 - RNA, 22 nt, Human
uccgucaaccccugcccguugc

SEQ ID NO: 1385330 - RNA, 23 nt, Human
ucucaaaaaaaaaaaaacaaaaa

SEQ ID NO: 1385331 - RNA, 26 nt, Human
ucucaaaaaaaaaaaaacaaaaaaaa

SEQ ID NO: 1385332 - RNA, 22 nt, Human
ucucacucugucaccaaggcug

SEQ ID NO: 1385333 - RNA, 24 nt, Human
ucucacucugucaccaaggcugga

SEQ ID NO: 1385334 - RNA, 18 nt, Human
ucugacagucugaaucug

SEQ ID NO: 1385335 - RNA, 24 nt, Human
ucugacagucugaaucugucuugu

SEQ ID NO: 1385336 - RNA, 24 nt, Human
ucugaguuuaucugcgccacuugu

SEQ ID NO: 1385337 - RNA, 21 nt, Human
ucugucaccaaggcuggaagc

SEQ ID NO: 1385338 - RNA, 18 nt, Human
ugaauguggcccaacaua

SEQ ID NO: 1385339 - RNA, 21 nt, Human
ugccuuggcaaugacagacaa

SEQ ID NO: 1385340 - RNA, 23 nt, Human
uggauggaaaagaaaggaaccug

SEQ ID NO: 1385341 - RNA, 25 nt, Human
uggcaaugacagacaagcugggguc

SEQ ID NO: 1385342 - RNA, 22 nt, Human
ugggauggagucucacucuguc

SEQ ID NO: 1385343 - RNA, 25 nt, Human
uggggugccuauuuugucuucccag

SEQ ID NO: 1385344 - RNA, 25 nt, Human
uguuaugaaguugcugaguuugggg

SEQ ID NO: 1385345 - RNA, 18 nt, Human
uguuuuugggauggaguc

SEQ ID NO: 1385346 - RNA, 20 nt, Human
uugcugaguuuggggugccu

SEQ ID NO: 1385347 - RNA, 21 nt, Human
uugggauggagucucacucug

SEQ ID NO: 1385348 - RNA, 18 nt, Human
uuguuguuguuguuuuug

SEQ ID NO: 1385349 - RNA, 25 nt, Human
uuuauucacauuuauaauaagaacu

SEQ ID NO: 1385350 - RNA, 22 nt, Human
uuuguaaacuuacuuaaaacau

SEQ ID NO: 1385351 - RNA, 19 nt, Human
aaaacaaacaaacaacaac

SEQ ID NO: 1385352 - RNA, 18 nt, Human
aaacaaacaaacaacaac

SEQ ID NO: 1385353 - RNA, 21 nt, Human
aaacaaauaagcaucccuucc

SEQ ID NO: 1385354 - RNA, 24 nt, Human
aaacaacaacaaaaaacugggcaa

SEQ ID NO: 1385355 - RNA, 19 nt, Human
aaaggccaggaccuuggag

SEQ ID NO: 1385356 - RNA, 19 nt, Human
aacaaaaaacugggcaacc

SEQ ID NO: 1385357 - RNA, 22 nt, Human
aacaaacaaacaacaacaaaaa

SEQ ID NO: 1385358 - RNA, 23 nt, Human
aacaaacaaacaacaacaaaaaa

SEQ ID NO: 1385359 - RNA, 21 nt, Human
aacagagggaaacuccgucuc

SEQ ID NO: 1385360 - RNA, 24 nt, Human
aacagagggaaacuccgucucaaa

SEQ ID NO: 1385361 - RNA, 22 nt, Human
aauaaaauccggagaggcgaag

SEQ ID NO: 1385362 - RNA, 19 nt, Human
acaaauaagcaucccuucc

SEQ ID NO: 1385363 - RNA, 25 nt, Human
acagagggaaacuccgucucaaaaa

SEQ ID NO: 1385364 - RNA, 21 nt, Human
acauuauugucaagagagucc

SEQ ID NO: 1385365 - RNA, 25 nt, Human
acuuugaacucuuuuccugaagccc

SEQ ID NO: 1385366 - RNA, 24 nt, Human
agccugggcaacagagggaaacuc

SEQ ID NO: 1385367 - RNA, 22 nt, Human
agcuccaaauucaccaucuccc

SEQ ID NO: 1385368 - RNA, 18 nt, Human
auuuuucuguuucaaagu

SEQ ID NO: 1385369 - RNA, 21 nt, Human
caacaaaaaacugggcaacca

SEQ ID NO: 1385370 - RNA, 23 nt, Human
caacaaaaaacugggcaaccacc

SEQ ID NO: 1385371 - RNA, 19 nt, Human
caacaacaaaaaacugggc

SEQ ID NO: 1385372 - RNA, 22 nt, Human
cacauuauugucaagagagucc

SEQ ID NO: 1385373 - RNA, 22 nt, Human
cagccugggcaacagagggaaa

SEQ ID NO: 1385374 - RNA, 19 nt, Human
caggaaaggccaggaccuu

SEQ ID NO: 1385375 - RNA, 22 nt, Human
cccuuugcuguuggcuuggaca

SEQ ID NO: 1385376 - RNA, 20 nt, Human
cugcauauuauaucuucccu

SEQ ID NO: 1385377 - RNA, 24 nt, Human
cuuacuuugaacucuuuuccugaa

SEQ ID NO: 1385378 - RNA, 22 nt, Human
cuugcuggcauuuugcagcugc

SEQ ID NO: 1385379 - RNA, 23 nt, Human
cuuucuaagcagccucucuugag

SEQ ID NO: 1385380 - RNA, 24 nt, Human
gacccagacuuucuaagcagccuc

SEQ ID NO: 1385381 - RNA, 20 nt, Human
gauauguuauccggaaauau

SEQ ID NO: 1385382 - RNA, 19 nt, Human
gcugaagauugagucagug

SEQ ID NO: 1385383 - RNA, 24 nt, Human
gcuguuggcuuggacaauaugugu

SEQ ID NO: 1385384 - RNA, 22 nt, Human
ggaaagaacucuuagaugugaa

SEQ ID NO: 1385385 - RNA, 23 nt, Human
ggucaccuuugaugucagaaaca

SEQ ID NO: 1385386 - RNA, 19 nt, Human
gucucagugcacccaaacc

SEQ ID NO: 1385387 - RNA, 23 nt, Human
gucucagugcacccaaaccccag

SEQ ID NO: 1385388 - RNA, 21 nt, Human
gugccagcacuauuuuaggua

SEQ ID NO: 1385389 - RNA, 24 nt, Human
uaaaauaaaauuuccacuuagaua

SEQ ID NO: 1385390 - RNA, 22 nt, Human
uaagcugcuuaugauuuuagcc

SEQ ID NO: 1385391 - RNA, 20 nt, Human
uacagaucuaauagauugga

SEQ ID NO: 1385392 - RNA, 26 nt, Human
uacauagaccaccaucaacuuauaau

SEQ ID NO: 1385393 - RNA, 21 nt, Human
uaccaguguuauaacagugaa

SEQ ID NO: 1385394 - RNA, 20 nt, Human
uaccuuugcagugugagucu

SEQ ID NO: 1385395 - RNA, 19 nt, Human
uacuuuacucacuugauua

SEQ ID NO: 1385396 - RNA, 27 nt, Human
uacuuuacucacuugauuaccgacuuc

SEQ ID NO: 1385397 - RNA, 22 nt, Human
uagcuaacaaaauccagcucca

SEQ ID NO: 1385398 - RNA, 25 nt, Human
ucaaaaacaaacaaacaacaacaaa

SEQ ID NO: 1385399 - RNA, 18 nt, Human
ucagugcacccaaacccc

SEQ ID NO: 1385400 - RNA, 20 nt, Human
uccaaauucaccaucucccu

SEQ ID NO: 1385401 - RNA, 18 nt, Human
uccaucauauugagauuu

SEQ ID NO: 1385402 - RNA, 19 nt, Human
ugaaaagcagcaacuugaa

SEQ ID NO: 1385403 - RNA, 20 nt, Human
ugaaaagcagcaacuugaaa

SEQ ID NO: 1385404 - RNA, 18 nt, Human
ugaaacaaauaagcaucc

SEQ ID NO: 1385405 - RNA, 19 nt, Human
ugaaacaaauaagcauccc

SEQ ID NO: 1385406 - RNA, 22 nt, Human
ugaaaugaaacaaauaagcauc

SEQ ID NO: 1385407 - RNA, 23 nt, Human
ugaauaaaguauuauuucugaug

SEQ ID NO: 1385408 - RNA, 24 nt, Human
ugaauaaaguauuauuucugaugg

SEQ ID NO: 1385409 - RNA, 20 nt, Human
ugaggaaacugaggcuccca

SEQ ID NO: 1385410 - RNA, 24 nt, Human
ugaggaaacugaggcucccaugag

SEQ ID NO: 1385411 - RNA, 19 nt, Human
ugccagcacuauuuuaggu

SEQ ID NO: 1385412 - RNA, 18 nt, Human
ugcuuggauguauuguag

SEQ ID NO: 1385413 - RNA, 21 nt, Human
ugguccaucauauugagauuu

SEQ ID NO: 1385414 - RNA, 27 nt, Human
uuaaaaaaaaaauugguuuggcucuau

SEQ ID NO: 1385415 - RNA, 23 nt, Human
uuagugccucuuuuauggucucu

SEQ ID NO: 1385416 - RNA, 19 nt, Human
uuauccggaaauauccuac

SEQ ID NO: 1385417 - RNA, 23 nt, Human
uucacauuauugucaagagaguc

SEQ ID NO: 1385418 - RNA, 22 nt, Human
uuccaaauacauagaccaccau

SEQ ID NO: 1385419 - RNA, 20 nt, Human
uucugauggaccaugcugcu

SEQ ID NO: 1385420 - RNA, 27 nt, Human
uugcugaagauugagucaguguuucca

SEQ ID NO: 1385421 - RNA, 23 nt, Human
uugcuggcauuuugcagcugcau

SEQ ID NO: 1385422 - RNA, 22 nt, Human
uuggagauuacacugacaguga

SEQ ID NO: 1385423 - RNA, 25 nt, Human
uuucuguucccucagcaauucacau

SEQ ID NO: 1385424 - RNA, 20 nt, Human
uuugaaucuaccguuuaaua

SEQ ID NO: 1385425 - RNA, 20 nt, Human
uuuucaaaccacuuuugcug

SEQ ID NO: 1385426 - RNA, 18 nt, Human
uuuucagaaacaaucacc

SEQ ID NO: 1385427 - RNA, 23 nt, Human
uuuucuugcuggcauuuugcagc

SEQ ID NO: 1385428 - RNA, 23 nt, Human
uuuugcagcugcauauuauaucu

SEQ ID NO: 1385429 - RNA, 25 nt, Human
aaaaagcucuguccacucuaggacc

SEQ ID NO: 1385430 - RNA, 18 nt, Human
aacucaaggcuguagcag

SEQ ID NO: 1385431 - RNA, 24 nt, Human
aacucacuucuccagccucaaaac

SEQ ID NO: 1385432 - RNA, 27 nt, Human
aacucacuucuccagccucaaaacccu

SEQ ID NO: 1385433 - RNA, 20 nt, Human
aagacaacagccaugaccac

SEQ ID NO: 1385434 - RNA, 23 nt, Human
aagacaacagccaugaccacuga

SEQ ID NO: 1385435 - RNA, 19 nt, Human
aagagggccccgaggcaca

SEQ ID NO: 1385436 - RNA, 23 nt, Human
aagcaggagggagaaagacaaga

SEQ ID NO: 1385437 - RNA, 19 nt, Human
aaggaggucagauuuccaa

SEQ ID NO: 1385438 - RNA, 23 nt, Human
aaggccccagcacccccugccca

SEQ ID NO: 1385439 - RNA, 23 nt, Human
aagggccucaccugaaggggagg

SEQ ID NO: 1385440 - RNA, 18 nt, Human
aaguagcagauucugaaa

SEQ ID NO: 1385441 - RNA, 24 nt, Human
aaucuguuuguaaaagcccuucca

SEQ ID NO: 1385442 - RNA, 21 nt, Human
aauuccgcaaauucccugcug

SEQ ID NO: 1385443 - RNA, 21 nt, Human
acaaccccagggugccccucc

SEQ ID NO: 1385444 - RNA, 21 nt, Human
acacaaccccagggugccccu

SEQ ID NO: 1385445 - RNA, 22 nt, Human
acacaaccccagggugccccuc

SEQ ID NO: 1385446 - RNA, 19 nt, Human
acagaagcuauggucucaa

SEQ ID NO: 1385447 - RNA, 24 nt, Human
accacaucguuggcucuggacucc

SEQ ID NO: 1385448 - RNA, 21 nt, Human
acccagagaagaggaggcaac

SEQ ID NO: 1385449 - RNA, 24 nt, Human
accccaugcuuuuuccagaaacag

SEQ ID NO: 1385450 - RNA, 19 nt, Human
acccugucucaucucccag

SEQ ID NO: 1385451 - RNA, 25 nt, Human
accggccccgaggcugggcuucccu

SEQ ID NO: 1385452 - RNA, 18 nt, Human
acgacacacagggcagga

SEQ ID NO: 1385453 - RNA, 21 nt, Human
acuccugaugagaaauucugg

SEQ ID NO: 1385454 - RNA, 19 nt, Human
agaaagaaggcagaaaagg

SEQ ID NO: 1385455 - RNA, 23 nt, Human
agaaagacaagaacggucacaaa

SEQ ID NO: 1385456 - RNA, 22 nt, Human
agacaacagccaugaccacuga

SEQ ID NO: 1385457 - RNA, 23 nt, Human
agauaaaccagccuaggcuccaa

SEQ ID NO: 1385458 - RNA, 20 nt, Human
agauggggcaggcuguccug

SEQ ID NO: 1385459 - RNA, 21 nt, Human
agauggggcaggcuguccugg

SEQ ID NO: 1385460 - RNA, 19 nt, Human
agcuaggcaggugcagggc

SEQ ID NO: 1385461 - RNA, 24 nt, Human
aggaacucaaggcuguagcagccc

SEQ ID NO: 1385462 - RNA, 21 nt, Human
aggagcuaggcacaaaggagg

SEQ ID NO: 1385463 - RNA, 18 nt, Human
aggaggucagauuuccaa

SEQ ID NO: 1385464 - RNA, 20 nt, Human
aggagugccgggguuccugg

SEQ ID NO: 1385465 - RNA, 23 nt, Human
aggcagaaaagggccucaccuga

SEQ ID NO: 1385466 - RNA, 23 nt, Human
aggcagcuaggcaggugcagggc

SEQ ID NO: 1385467 - RNA, 21 nt, Human
aggccccagcacccccugccc

SEQ ID NO: 1385468 - RNA, 23 nt, Human
aggcguguccucucucuccaagg

SEQ ID NO: 1385469 - RNA, 22 nt, Human
agggaagggcagcauggagugu

SEQ ID NO: 1385470 - RNA, 19 nt, Human
agggcccuggugugcaggg

SEQ ID NO: 1385471 - RNA, 19 nt, Human
agggugccggggaagcagg

SEQ ID NO: 1385472 - RNA, 24 nt, Human
aggugcugaagauggucugaaacc

SEQ ID NO: 1385473 - RNA, 21 nt, Human
aggugggaagggaagcagagc

SEQ ID NO: 1385474 - RNA, 25 nt, Human
agugguucucaaagugugguuccag

SEQ ID NO: 1385475 - RNA, 19 nt, Human
aucuaccauauucccccca

SEQ ID NO: 1385476 - RNA, 21 nt, Human
auuaucugcaugaaucccagg

SEQ ID NO: 1385477 - RNA, 18 nt, Human
caaaaaaaucccuggaca

SEQ ID NO: 1385478 - RNA, 20 nt, Human
caaagggcaaggucuucugg

SEQ ID NO: 1385479 - RNA, 24 nt, Human
caacagccaugaccacugacaagc

SEQ ID NO: 1385480 - RNA, 18 nt, Human
caagagggccccgaggca

SEQ ID NO: 1385481 - RNA, 20 nt, Human
caaggcaagagggccccgag

SEQ ID NO: 1385482 - RNA, 19 nt, Human
caaucuguuuguaaaagcc

SEQ ID NO: 1385483 - RNA, 21 nt, Human
caaugauaaggcugugcacag

SEQ ID NO: 1385484 - RNA, 18 nt, Human
cacaaaaaaaucccugga

SEQ ID NO: 1385485 - RNA, 21 nt, Human
cacaaccccagggugccccuc

SEQ ID NO: 1385486 - RNA, 23 nt, Human
cacaaugaucuaccauauucccc

SEQ ID NO: 1385487 - RNA, 21 nt, Human
cacagggcaccugccugucac

SEQ ID NO: 1385488 - RNA, 21 nt, Human
caccacucucccucugucgua

SEQ ID NO: 1385489 - RNA, 23 nt, Human
caccccagagccccagcaauagc

SEQ ID NO: 1385490 - RNA, 21 nt, Human
cacccccugcccacugccgcc

SEQ ID NO: 1385491 - RNA, 21 nt, Human
cacugccugagccccugcacc

SEQ ID NO: 1385492 - RNA, 18 nt, Human
cacuggagaacacccaga

SEQ ID NO: 1385493 - RNA, 27 nt, Human
cagaugccccucuauucagagcugccc

SEQ ID NO: 1385494 - RNA, 19 nt, Human
cagcaauagcaggugcccc

SEQ ID NO: 1385495 - RNA, 22 nt, Human
cagcacuggguggccuugaggc

SEQ ID NO: 1385496 - RNA, 21 nt, Human
cagcaggaggggcacaccccg

SEQ ID NO: 1385497 - RNA, 24 nt, Human
cagccaugaccacugacaagcaag

SEQ ID NO: 1385498 - RNA, 25 nt, Human
cagccuguggcugcccuacccaggu

SEQ ID NO: 1385499 - RNA, 18 nt, Human
cagcuaaggacaggggua

SEQ ID NO: 1385500 - RNA, 23 nt, Human
cagcuggacagccugagguacuc

SEQ ID NO: 1385501 - RNA, 23 nt, Human
caggagcugggagggagcagaga

SEQ ID NO: 1385502 - RNA, 20 nt, Human
cagggaggugagcugggacc

SEQ ID NO: 1385503 - RNA, 21 nt, Human
caggguugcucugggaguggg

SEQ ID NO: 1385504 - RNA, 20 nt, Human
caggucaaagggcaaggucu

SEQ ID NO: 1385505 - RNA, 19 nt, Human
cauccccaccagggcagac

SEQ ID NO: 1385506 - RNA, 22 nt, Human
caugaccacugacaagcaaggg

SEQ ID NO: 1385507 - RNA, 20 nt, Human
caugagauucugcacccugc

SEQ ID NO: 1385508 - RNA, 23 nt, Human
cauuguacacucccaggcagaac

SEQ ID NO: 1385509 - RNA, 22 nt, Human
ccaacucacuucuccagccuca

SEQ ID NO: 1385510 - RNA, 22 nt, Human
ccaaggaaaaagcucuguccac

SEQ ID NO: 1385511 - RNA, 20 nt, Human
ccacaggcguguccucucuc

SEQ ID NO: 1385512 - RNA, 19 nt, Human
ccacagggccgugcugggc

SEQ ID NO: 1385513 - RNA, 22 nt, Human
ccacaucguuggcucuggacuc

SEQ ID NO: 1385514 - RNA, 22 nt, Human
ccacuuacucugccugaggggc

SEQ ID NO: 1385515 - RNA, 21 nt, Human
ccagaaacagcaaggucaggg

SEQ ID NO: 1385516 - RNA, 21 nt, Human
ccaggaaaagugagguucagg

SEQ ID NO: 1385517 - RNA, 18 nt, Human
ccaggcuguuggcaugga

SEQ ID NO: 1385518 - RNA, 20 nt, Human
ccaggugggugacagggugg

SEQ ID NO: 1385519 - RNA, 23 nt, Human
ccaguauaucaagaauguuuucc

SEQ ID NO: 1385520 - RNA, 22 nt, Human
ccaugggggcucagaaauggag

SEQ ID NO: 1385521 - RNA, 24 nt, Human
cccaacucacuucuccagccucaa

SEQ ID NO: 1385522 - RNA, 23 nt, Human
cccaaguagcagauucugaaaca

SEQ ID NO: 1385523 - RNA, 24 nt, Human
cccaccccaugcuuuuuccagaaa

SEQ ID NO: 1385524 - RNA, 18 nt, Human
cccaggccuccccacucc

SEQ ID NO: 1385525 - RNA, 20 nt, Human
ccccacaccccacagggccg

SEQ ID NO: 1385526 - RNA, 23 nt, Human
ccccacaccccacagggccgugc

SEQ ID NO: 1385527 - RNA, 20 nt, Human
ccccaccccaugcuuuuucc

SEQ ID NO: 1385528 - RNA, 23 nt, Human
ccccaccccaugcuuuuuccaga

SEQ ID NO: 1385529 - RNA, 24 nt, Human
ccccagcacccccugcccacugcc

SEQ ID NO: 1385530 - RNA, 18 nt, Human
ccccaggaaaagugaggu

SEQ ID NO: 1385531 - RNA, 18 nt, Human
ccccagggugccccuccc

SEQ ID NO: 1385532 - RNA, 19 nt, Human
ccccagggugccccucccu

SEQ ID NO: 1385533 - RNA, 19 nt, Human
ccccagucaggcuggacca

SEQ ID NO: 1385534 - RNA, 20 nt, Human
cccccacaccccacagggcc

SEQ ID NO: 1385535 - RNA, 18 nt, Human
ccccccacaccccacagg

SEQ ID NO: 1385536 - RNA, 18 nt, Human
cccccggcccaugugcca

SEQ ID NO: 1385537 - RNA, 21 nt, Human
cccccuagcacaugaagcugg

SEQ ID NO: 1385538 - RNA, 21 nt, Human
ccccggaacaggagauucccg

SEQ ID NO: 1385539 - RNA, 18 nt, Human
ccccugagugacacucug

SEQ ID NO: 1385540 - RNA, 21 nt, Human
ccccugagugacacucuguuc

SEQ ID NO: 1385541 - RNA, 23 nt, Human
ccccuucucagcagcuccgacuu

SEQ ID NO: 1385542 - RNA, 22 nt, Human
cccgaggcugggcuucccucug

SEQ ID NO: 1385543 - RNA, 21 nt, Human
cccgcucuggggagaagugca

SEQ ID NO: 1385544 - RNA, 21 nt, Human
cccggaacaggagauucccga

SEQ ID NO: 1385545 - RNA, 18 nt, Human
cccuacccaggccucccc

SEQ ID NO: 1385546 - RNA, 19 nt, Human
cccucccugccccacccca

SEQ ID NO: 1385547 - RNA, 23 nt, Human
cccugcaugaaggcccugagggc

SEQ ID NO: 1385548 - RNA, 23 nt, Human
cccugcccaggaucuggccaugg

SEQ ID NO: 1385549 - RNA, 19 nt, Human
cccugcuuccugccagggc

SEQ ID NO: 1385550 - RNA, 22 nt, Human
ccucaaaacccugaagagggcc

SEQ ID NO: 1385551 - RNA, 20 nt, Human
ccuccauguggacaugagau

SEQ ID NO: 1385552 - RNA, 24 nt, Human
ccucgcucagccuuggccuuagcc

SEQ ID NO: 1385553 - RNA, 22 nt, Human
ccugaaaauuccgcaaauuccc

SEQ ID NO: 1385554 - RNA, 20 nt, Human
ccugagccccugcacccaga

SEQ ID NO: 1385555 - RNA, 22 nt, Human
ccugagccccugcacccagagg

SEQ ID NO: 1385556 - RNA, 18 nt, Human
ccugccccagucaggcug

SEQ ID NO: 1385557 - RNA, 19 nt, Human
ccugggugggcacagaagc

SEQ ID NO: 1385558 - RNA, 20 nt, Human
ccuucuccccagcugggggu

SEQ ID NO: 1385559 - RNA, 21 nt, Human
cgggaggaauugaccugggua

SEQ ID NO: 1385560 - RNA, 21 nt, Human
cuagcacaugaagcugggcuu

SEQ ID NO: 1385561 - RNA, 24 nt, Human
cuauaccauuucucucggccucug

SEQ ID NO: 1385562 - RNA, 27 nt, Human
cucaaaacccugaagagggcccaaggg

SEQ ID NO: 1385563 - RNA, 23 nt, Human
cucaccacucucccucugucgua

SEQ ID NO: 1385564 - RNA, 27 nt, Human
cucagccuuggccuuagcacaaggugc

SEQ ID NO: 1385565 - RNA, 23 nt, Human
cuccaaacaggggcccgggagga

SEQ ID NO: 1385566 - RNA, 19 nt, Human
cuccaaggcaagagggccc

SEQ ID NO: 1385567 - RNA, 22 nt, Human
cucccaggcagaaccugccgua

SEQ ID NO: 1385568 - RNA, 24 nt, Human
cuccccacuccuaggcccuucagg

SEQ ID NO: 1385569 - RNA, 21 nt, Human
cuccuagugcagcaugugcug

SEQ ID NO: 1385570 - RNA, 20 nt, Human
cucucucucaccacucuccc

SEQ ID NO: 1385571 - RNA, 21 nt, Human
cugcugcagguggagcucagc

SEQ ID NO: 1385572 - RNA, 21 nt, Human
cugcuuccugccagggcggcu

SEQ ID NO: 1385573 - RNA, 24 nt, Human
cuggauguaaacaccucuggccau

SEQ ID NO: 1385574 - RNA, 18 nt, Human
cugggccucuguuuccuc

SEQ ID NO: 1385575 - RNA, 22 nt, Human
cuuaaugacagccugauggcuc

SEQ ID NO: 1385576 - RNA, 24 nt, Human
cuuugugacagugcccccugaguu

SEQ ID NO: 1385577 - RNA, 22 nt, Human
gaaauggaggagagggggccga

SEQ ID NO: 1385578 - RNA, 18 nt, Human
gaacacccagagaagagg

SEQ ID NO: 1385579 - RNA, 22 nt, Human
gaacauggcucuagcccaguac

SEQ ID NO: 1385580 - RNA, 21 nt, Human
gaagaacauggcucuagccca

SEQ ID NO: 1385581 - RNA, 24 nt, Human
gaauugcagcuaauccugccccag

SEQ ID NO: 1385582 - RNA, 25 nt, Human
gagaacacccagagaagagggaguc

SEQ ID NO: 1385583 - RNA, 19 nt, Human
gagaacccaaccgccaccc

SEQ ID NO: 1385584 - RNA, 22 nt, Human
gagagcacgccugccccaggac

SEQ ID NO: 1385585 - RNA, 25 nt, Human
gagcugggagggagcagagaaccca

SEQ ID NO: 1385586 - RNA, 25 nt, Human
gagcuggggaggguggaagccaggu

SEQ ID NO: 1385587 - RNA, 24 nt, Human
gagggagaaagacaagaacgguca

SEQ ID NO: 1385588 - RNA, 22 nt, Human
gauuuucuuucuguucucccuu

SEQ ID NO: 1385589 - RNA, 21 nt, Human
gcaauagcaggugccccaugc

SEQ ID NO: 1385590 - RNA, 26 nt, Human
gcacuauaccauuucucucggccucu

SEQ ID NO: 1385591 - RNA, 22 nt, Human
gcagaaaagggccucaccugaa

SEQ ID NO: 1385592 - RNA, 21 nt, Human
gccagcagcugcagcuccugg

SEQ ID NO: 1385593 - RNA, 21 nt, Human
gcccaugugccaugggugcug

SEQ ID NO: 1385594 - RNA, 18 nt, Human
gccccgaggcugggcuuc

SEQ ID NO: 1385595 - RNA, 21 nt, Human
gcccuacccaggccuccccac

SEQ ID NO: 1385596 - RNA, 18 nt, Human
gcccuggguuguucuacc

SEQ ID NO: 1385597 - RNA, 26 nt, Human
gcccuggugugcaggggccuuuugcc

SEQ ID NO: 1385598 - RNA, 22 nt, Human
gccgcuuggacaagccaucuuu

SEQ ID NO: 1385599 - RNA, 19 nt, Human
gccuaggcuccaagaagcc

SEQ ID NO: 1385600 - RNA, 18 nt, Human
gccugaaauaagccaggc

SEQ ID NO: 1385601 - RNA, 20 nt, Human
gcguguccucucucuccaag

SEQ ID NO: 1385602 - RNA, 21 nt, Human
gcuacggggucaaggagaggg

SEQ ID NO: 1385603 - RNA, 21 nt, Human
gcucagccuuggccuuagcac

SEQ ID NO: 1385604 - RNA, 18 nt, Human
gcucuggggagaagugca

SEQ ID NO: 1385605 - RNA, 24 nt, Human
gcugaagauggucugaaaccuggu

SEQ ID NO: 1385606 - RNA, 20 nt, Human
gcugaaugcaggagugccgg

SEQ ID NO: 1385607 - RNA, 20 nt, Human
gcuggguggucgucacgggc

SEQ ID NO: 1385608 - RNA, 20 nt, Human
gcuguuggcauggacaagga

SEQ ID NO: 1385609 - RNA, 24 nt, Human
gcuucacuccuagcccccaauggu

SEQ ID NO: 1385610 - RNA, 19 nt, Human
ggaaauaacacccucuugc

SEQ ID NO: 1385611 - RNA, 24 nt, Human
ggaacucaaggcuguagcagccuc

SEQ ID NO: 1385612 - RNA, 20 nt, Human
ggaagggaagcagagcugga

SEQ ID NO: 1385613 - RNA, 20 nt, Human
ggagauggagaacuggggga

SEQ ID NO: 1385614 - RNA, 21 nt, Human
ggagcuaggcacaaaggaggg

SEQ ID NO: 1385615 - RNA, 19 nt, Human
ggaggagagggggccgagg

SEQ ID NO: 1385616 - RNA, 19 nt, Human
ggaggagagggggccgagg

SEQ ID NO: 1385617 - RNA, 23 nt, Human
ggagguuucucccaggaaggcag

SEQ ID NO: 1385618 - RNA, 18 nt, Human
ggccagggcuuggggcca

SEQ ID NO: 1385619 - RNA, 20 nt, Human
ggcucugcuccuagugcagc

SEQ ID NO: 1385620 - RNA, 18 nt, Human
ggcugcugcagguggagc

SEQ ID NO: 1385621 - RNA, 19 nt, Human
ggcuggggcagauggggca

SEQ ID NO: 1385622 - RNA, 18 nt, Human
ggcuggguggucgucacg

SEQ ID NO: 1385623 - RNA, 21 nt, Human
gggaagcaggagggagaaaga

SEQ ID NO: 1385624 - RNA, 20 nt, Human
gggagagagagcacgccugc

SEQ ID NO: 1385625 - RNA, 21 nt, Human
gggagguggucaacacaaccc

SEQ ID NO: 1385626 - RNA, 21 nt, Human
gggcuggguggucgucacggg

SEQ ID NO: 1385627 - RNA, 25 nt, Human
ggggaggguggaagccagguguggg

SEQ ID NO: 1385628 - RNA, 23 nt, Human
ggggcucagaaauggaggagagg

SEQ ID NO: 1385629 - RNA, 19 nt, Human
ggggcuggggcagaugggg

SEQ ID NO: 1385630 - RNA, 23 nt, Human
ggggguggggccagcaaucuguu

SEQ ID NO: 1385631 - RNA, 25 nt, Human
ggguggaagccaggugugggguucu

SEQ ID NO: 1385632 - RNA, 19 nt, Human
ggguggguggugaugacag

SEQ ID NO: 1385633 - RNA, 19 nt, Human
ggguguuguacaaaaagcu

SEQ ID NO: 1385634 - RNA, 19 nt, Human
gguaaacacaaaaaaaucc

SEQ ID NO: 1385635 - RNA, 19 nt, Human
ggugggugacagggugggu

SEQ ID NO: 1385636 - RNA, 20 nt, Human
guagugaaugggcugccccu

SEQ ID NO: 1385637 - RNA, 19 nt, Human
gucaacacaaccccagggu

SEQ ID NO: 1385638 - RNA, 24 nt, Human
gucccaacucacuucuccagccuc

SEQ ID NO: 1385639 - RNA, 21 nt, Human
gugagguucaggcagaugccc

SEQ ID NO: 1385640 - RNA, 21 nt, Human
gugcugggcccuucuggaugu

SEQ ID NO: 1385641 - RNA, 21 nt, Human
guggagagugggcaggucaaa

SEQ ID NO: 1385642 - RNA, 24 nt, Human
guuuuccaggugggugacagggug

SEQ ID NO: 1385643 - RNA, 22 nt, Human
uacaaaaagcugccagcaugga

SEQ ID NO: 1385644 - RNA, 23 nt, Human
uaccauauuccccccacacccca

SEQ ID NO: 1385645 - RNA, 21 nt, Human
uaccauuucucucggccucug

SEQ ID NO: 1385646 - RNA, 20 nt, Human
uaccuggggugacgggcugg

SEQ ID NO: 1385647 - RNA, 24 nt, Human
uagaaagaaggcagaaaagggccu

SEQ ID NO: 1385648 - RNA, 18 nt, Human
uagugaaugggcugcccc

SEQ ID NO: 1385649 - RNA, 23 nt, Human
uaucacuagaggccagggcuugg

SEQ ID NO: 1385650 - RNA, 26 nt, Human
uauggagauggagaacugggggacac

SEQ ID NO: 1385651 - RNA, 23 nt, Human
ucaacacaaccccagggugcccc

SEQ ID NO: 1385652 - RNA, 23 nt, Human
ucaaggagagggccccaggaaaa

SEQ ID NO: 1385653 - RNA, 24 nt, Human
ucaggagcugggagggagcagaga

SEQ ID NO: 1385654 - RNA, 21 nt, Human
uccaagaagccacuggagaac

SEQ ID NO: 1385655 - RNA, 18 nt, Human
uccaaggcaagagggccc

SEQ ID NO: 1385656 - RNA, 23 nt, Human
uccacgggugcccccguuccugg

SEQ ID NO: 1385657 - RNA, 21 nt, Human
uccagaaacagcaaggucagg

SEQ ID NO: 1385658 - RNA, 19 nt, Human
ucccaacucacuucuccag

SEQ ID NO: 1385659 - RNA, 22 nt, Human
ucccagggagguuucucccagg

SEQ ID NO: 1385660 - RNA, 23 nt, Human
uccccagcuggggguggcaagac

SEQ ID NO: 1385661 - RNA, 20 nt, Human
ucccguaguccacgggugcc

SEQ ID NO: 1385662 - RNA, 18 nt, Human
ucccuggacacacucccc

SEQ ID NO: 1385663 - RNA, 18 nt, Human
uccgcaaauucccugcug

SEQ ID NO: 1385664 - RNA, 27 nt, Human
uccuagggcccuggugugcaggggccu

SEQ ID NO: 1385665 - RNA, 21 nt, Human
uccugccccagucaggcugga

SEQ ID NO: 1385666 - RNA, 24 nt, Human
uccuggagauggggcuagggugcc

SEQ ID NO: 1385667 - RNA, 20 nt, Human
uccugggccucuguuuccuc

SEQ ID NO: 1385668 - RNA, 21 nt, Human
uccugggccugccuucaauga

SEQ ID NO: 1385669 - RNA, 18 nt, Human
uccuuuauuaucauuauc

SEQ ID NO: 1385670 - RNA, 20 nt, Human
ucucaaagugugguuccagg

SEQ ID NO: 1385671 - RNA, 18 nt, Human
ucucaccacucucccucu

SEQ ID NO: 1385672 - RNA, 18 nt, Human
ucugccgauuguuccagg

SEQ ID NO: 1385673 - RNA, 21 nt, Human
ucuggcuggacgacacacagg

SEQ ID NO: 1385674 - RNA, 18 nt, Human
ucuuccuucuccccagcu

SEQ ID NO: 1385675 - RNA, 22 nt, Human
ucuuucucucucucaccacucu

SEQ ID NO: 1385676 - RNA, 18 nt, Human
ugaaacaaagcuggcucc

SEQ ID NO: 1385677 - RNA, 21 nt, Human
ugaaacaaagcuggcuccaag

SEQ ID NO: 1385678 - RNA, 23 nt, Human
ugaaugcaggagugccgggguuc

SEQ ID NO: 1385679 - RNA, 24 nt, Human
ugaccuccauguggacaugagauu

SEQ ID NO: 1385680 - RNA, 20 nt, Human
ugcccacugccgccuccccc

SEQ ID NO: 1385681 - RNA, 22 nt, Human
ugccugaggggcuccuggagau

SEQ ID NO: 1385682 - RNA, 19 nt, Human
ugccugggugggcacagaa

SEQ ID NO: 1385683 - RNA, 22 nt, Human
ugccugggugggcacagaagcu

SEQ ID NO: 1385684 - RNA, 18 nt, Human
ugcucugggagugggugu

SEQ ID NO: 1385685 - RNA, 18 nt, Human
ugcucuugcuuugggguc

SEQ ID NO: 1385686 - RNA, 23 nt, Human
uggagaacacccagagaagagga

SEQ ID NO: 1385687 - RNA, 21 nt, Human
uggauguaaacaccucuggcc

SEQ ID NO: 1385688 - RNA, 20 nt, Human
uggauucgcaggagcuaggc

SEQ ID NO: 1385689 - RNA, 19 nt, Human
uggccuugaggccacuccu

SEQ ID NO: 1385690 - RNA, 23 nt, Human
uggcuacggggucaaggagaggg

SEQ ID NO: 1385691 - RNA, 18 nt, Human
uggcuccaaggcaagagg

SEQ ID NO: 1385692 - RNA, 18 nt, Human
uggcucuggacuccaacc

SEQ ID NO: 1385693 - RNA, 22 nt, Human
uggcugcaucuuccuuuggugu

SEQ ID NO: 1385694 - RNA, 18 nt, Human
ugggagagagagcacgcc

SEQ ID NO: 1385695 - RNA, 19 nt, Human
ugggcaggucaaagggcaa

SEQ ID NO: 1385696 - RNA, 26 nt, Human
ugggcucuuggccacugccugagccc

SEQ ID NO: 1385697 - RNA, 19 nt, Human
uggggaggguggaagccag

SEQ ID NO: 1385698 - RNA, 22 nt, Human
uggggcaggcuguccugggccu

SEQ ID NO: 1385699 - RNA, 18 nt, Human
uggggccagcaaucuguu

SEQ ID NO: 1385700 - RNA, 19 nt, Human
uggggccauggucucccag

SEQ ID NO: 1385701 - RNA, 21 nt, Human
ugggggguggggccagcaauc

SEQ ID NO: 1385702 - RNA, 22 nt, Human
ugggggguggggccagcaaucu

SEQ ID NO: 1385703 - RNA, 23 nt, Human
uggugguggcuacggggucaagg

SEQ ID NO: 1385704 - RNA, 28 nt, Human
uggugugcaggggccuuuugggcggggc

SEQ ID NO: 1385705 - RNA, 19 nt, Human
uguacacucccaggcagaa

SEQ ID NO: 1385706 - RNA, 18 nt, Human
uguagugaaugggcugcc

SEQ ID NO: 1385707 - RNA, 22 nt, Human
uuccuggguuuucugccgauug

SEQ ID NO: 1385708 - RNA, 20 nt, Human
uuccuggugaggggcucugg

SEQ ID NO: 1385709 - RNA, 22 nt, Human
uucuccagccucaaaacccuga

SEQ ID NO: 1385710 - RNA, 20 nt, Human
uuggcaaccccagggccuuu

SEQ ID NO: 1385711 - RNA, 22 nt, Human
uuguuccagguucaggagcugg

SEQ ID NO: 1385712 - RNA, 24 nt, Human
uuuccaggugggugacaggguggg

SEQ ID NO: 1385713 - RNA, 22 nt, Human
uuugagaacgacugguuuagac

SEQ ID NO: 1385714 - RNA, 21 nt, Human
uuuggggucaguguuuguacc

SEQ ID NO: 1385715 - RNA, 21 nt, Human
uuugugacagugcccccugag

SEQ ID NO: 1385716 - RNA, 18 nt, Human
agucaggaaacacaugug

SEQ ID NO: 1385717 - RNA, 18 nt, Human
augaaaauggggagcagg

SEQ ID NO: 1385718 - RNA, 21 nt, Human
caacuggucuucagagcugaa

SEQ ID NO: 1385719 - RNA, 26 nt, Human
cauccugagcucaguccccaaucucc

SEQ ID NO: 1385720 - RNA, 22 nt, Human
ccacccagagacaucugguauc

SEQ ID NO: 1385721 - RNA, 21 nt, Human
ccaccugucccaacccagggu

SEQ ID NO: 1385722 - RNA, 25 nt, Human
ccacuggauaaaucugaguucacac

SEQ ID NO: 1385723 - RNA, 19 nt, Human
cccaacccaggguacccac

SEQ ID NO: 1385724 - RNA, 21 nt, Human
cccaugaaaauggggagcagg

SEQ ID NO: 1385725 - RNA, 19 nt, Human
ccccaaucucccaccagcc

SEQ ID NO: 1385726 - RNA, 28 nt, Human
ccuacuuccauccugagcucagucccca

SEQ ID NO: 1385727 - RNA, 23 nt, Human
cucaggccccuccacuucucaga

SEQ ID NO: 1385728 - RNA, 20 nt, Human
gggagcaggcuguaacagau

SEQ ID NO: 1385729 - RNA, 18 nt, Human
ucccaacccaggguaccc

SEQ ID NO: 1385730 - RNA, 18 nt, Human
ucugaccuaaaugugaag

SEQ ID NO: 1385731 - RNA, 21 nt, Human
ugagcucaguccccaaucucc

SEQ ID NO: 1385732 - RNA, 18 nt, Human
uggucuucagagcugaag

SEQ ID NO: 1385733 - RNA, 23 nt, Human
uuguccacauguuccuaccaccu

SEQ ID NO: 1385734 - RNA, 19 nt, Human
aaacaccacaaugaugaaa

SEQ ID NO: 1385735 - RNA, 21 nt, Human
aacacaggugccugguuaggc

SEQ ID NO: 1385736 - RNA, 18 nt, Human
aagcaccuuuaaugagag

SEQ ID NO: 1385737 - RNA, 23 nt, Human
acaaugaugaaaauaccaagcac

SEQ ID NO: 1385738 - RNA, 21 nt, Human
cacagucagguagacaaacac

SEQ ID NO: 1385739 - RNA, 22 nt, Human
cgcuuggagcauugcuuugcuc

SEQ ID NO: 1385740 - RNA, 19 nt, Human
gacuuauuuuccacaguca

SEQ ID NO: 1385741 - RNA, 22 nt, Human
gcccagacaccgaucugugaga

SEQ ID NO: 1385742 - RNA, 18 nt, Human
gccugcucaaauauggaa

SEQ ID NO: 1385743 - RNA, 20 nt, Human
gcuccuaaauuacuuaacca

SEQ ID NO: 1385744 - RNA, 18 nt, Human
ggaaggcucccugcaagg

SEQ ID NO: 1385745 - RNA, 21 nt, Human
ggaaggcucccugcaagggag

SEQ ID NO: 1385746 - RNA, 21 nt, Human
gugccugguuaggcagguucc

SEQ ID NO: 1385747 - RNA, 22 nt, Human
uagaaguuuggccucuuuucug

SEQ ID NO: 1385748 - RNA, 22 nt, Human
uaggcuggcccuucaggguagu

SEQ ID NO: 1385749 - RNA, 20 nt, Human
ugaaaauaccaagcacagca

SEQ ID NO: 1385750 - RNA, 27 nt, Human
ugauagaaguuuggccucuuuucugau

SEQ ID NO: 1385751 - RNA, 24 nt, Human
aagcuuguuuuccugcaacuggau

SEQ ID NO: 1385752 - RNA, 23 nt, Human
agauggagccauuacacugagcc

SEQ ID NO: 1385753 - RNA, 20 nt, Human
caccccuaagcucgcaggac

SEQ ID NO: 1385754 - RNA, 21 nt, Human
caccccuaagcucgcaggaca

SEQ ID NO: 1385755 - RNA, 25 nt, Human
caccugaauaacauguugcccaguc

SEQ ID NO: 1385756 - RNA, 18 nt, Human
caguaugugguagcuuga

SEQ ID NO: 1385757 - RNA, 24 nt, Human
cagucagucucucuuccuggauuc

SEQ ID NO: 1385758 - RNA, 22 nt, Human
ccaccugaauaacauguugccc

SEQ ID NO: 1385759 - RNA, 22 nt, Human
ccuuguccugugcaucucuuuc

SEQ ID NO: 1385760 - RNA, 18 nt, Human
cgaaaggauccaucccau

SEQ ID NO: 1385761 - RNA, 20 nt, Human
gcccugugguuggagaccgc

SEQ ID NO: 1385762 - RNA, 18 nt, Human
uaacagaaaauaaggugg

SEQ ID NO: 1385763 - RNA, 23 nt, Human
uaacagaaaauaagguggccaga

SEQ ID NO: 1385764 - RNA, 25 nt, Human
ucaacaguaugugguagcuugaguc

SEQ ID NO: 1385765 - RNA, 24 nt, Human
ucaagugcauucgaaaggauccau

SEQ ID NO: 1385766 - RNA, 21 nt, Human
ucuguggcccugugguuggag

SEQ ID NO: 1385767 - RNA, 21 nt, Human
uuuuccugcaacuggaugguc

SEQ ID NO: 1385768 - RNA, 23 nt, Human
aaaaugccuccauaucccaaauu

SEQ ID NO: 1385769 - RNA, 23 nt, Human
aacaucuccguauaccaaguagc

SEQ ID NO: 1385770 - RNA, 18 nt, Human
aaguaguagugacagaag

SEQ ID NO: 1385771 - RNA, 19 nt, Human
aauacauuucacauggaau

SEQ ID NO: 1385772 - RNA, 21 nt, Human
aauggaagauaauuaucuaaa

SEQ ID NO: 1385773 - RNA, 25 nt, Human
aaugucaaccuugcaguuuaaacaa

SEQ ID NO: 1385774 - RNA, 23 nt, Human
acaacacaauaaaugucaaccuu

SEQ ID NO: 1385775 - RNA, 23 nt, Human
acauuagaucgaaauuaacuuag

SEQ ID NO: 1385776 - RNA, 23 nt, Human
aggauccaaagaguuauuuugaa

SEQ ID NO: 1385777 - RNA, 25 nt, Human
aguaaaugguugauggcccauacaa

SEQ ID NO: 1385778 - RNA, 18 nt, Human
agugccagucuugguucg

SEQ ID NO: 1385779 - RNA, 26 nt, Human
augugaacauacacaaacauauucuu

SEQ ID NO: 1385780 - RNA, 19 nt, Human
cacaacacaauaaauguca

SEQ ID NO: 1385781 - RNA, 22 nt, Human
caguaggcuaucucuguaggau

SEQ ID NO: 1385782 - RNA, 21 nt, Human
ccagaccugcaucuggcuugu

SEQ ID NO: 1385783 - RNA, 23 nt, Human
cuggugcagugugaaucuuucuu

SEQ ID NO: 1385784 - RNA, 21 nt, Human
cuuagacacaacacaauaaau

SEQ ID NO: 1385785 - RNA, 18 nt, Human
cuuuccucuuucuuggcu

SEQ ID NO: 1385786 - RNA, 22 nt, Human
gaacauacacaaacauauucuu

SEQ ID NO: 1385787 - RNA, 19 nt, Human
guaaaugacagaacacuuu

SEQ ID NO: 1385788 - RNA, 18 nt, Human
guucgugcuuggcugaca

SEQ ID NO: 1385789 - RNA, 25 nt, Human
uaaguaguagugacagaagauaaaa

SEQ ID NO: 1385790 - RNA, 23 nt, Human
uaauaggucuugugguggugaau

SEQ ID NO: 1385791 - RNA, 24 nt, Human
uagacacaacacaauaaaugucaa

SEQ ID NO: 1385792 - RNA, 22 nt, Human
uagaucgaaauuaacuuagaca

SEQ ID NO: 1385793 - RNA, 19 nt, Human
uagauugaaagauuaauga

SEQ ID NO: 1385794 - RNA, 23 nt, Human
uauuuaaaauggaagauaauuau

SEQ ID NO: 1385795 - RNA, 23 nt, Human
ucagaguuuuaaguaguagugac

SEQ ID NO: 1385796 - RNA, 23 nt, Human
uccaaagaguuauuuugaacccc

SEQ ID NO: 1385797 - RNA, 21 nt, Human
ucugcaaacuugacauuaaag

SEQ ID NO: 1385798 - RNA, 23 nt, Human
ucuugugguggugaauaauuaga

SEQ ID NO: 1385799 - RNA, 23 nt, Human
ugauagugaaauauuauaagcac

SEQ ID NO: 1385800 - RNA, 19 nt, Human
ugcaaacuugacauuaaag

SEQ ID NO: 1385801 - RNA, 19 nt, Human
ugccagucuugguucgugc

SEQ ID NO: 1385802 - RNA, 21 nt, Human
ugugaacauacacaaacauag

SEQ ID NO: 1385803 - RNA, 24 nt, Human
ugugaaucuuucuucuuagggugu

SEQ ID NO: 1385804 - RNA, 23 nt, Human
ugugguggugaauaauuagauug

SEQ ID NO: 1385805 - RNA, 26 nt, Human
uuagcaaaaaaaucuaacauaaucau

SEQ ID NO: 1385806 - RNA, 22 nt, Human
uuauuaguuagcaaaaaaaucu

SEQ ID NO: 1385807 - RNA, 19 nt, Human
uucacagaggcuagaauca

SEQ ID NO: 1385808 - RNA, 24 nt, Human
uugauggcccauacaauauucucu

SEQ ID NO: 1385809 - RNA, 23 nt, Human
uugauggggguacaagguagugg

SEQ ID NO: 1385810 - RNA, 20 nt, Human
uuugucauuaaucaauacaa

SEQ ID NO: 1385811 - RNA, 27 nt, Human
uuuucagagacaauucuucgggucacc

SEQ ID NO: 1385812 - RNA, 27 nt, Human
aaaaagcaccugcugcaccguaagccc

SEQ ID NO: 1385813 - RNA, 25 nt, Human
aaaauucuucccaugagagugacuu

SEQ ID NO: 1385814 - RNA, 24 nt, Human
aaaguuuuauccgcuuucccauau

SEQ ID NO: 1385815 - RNA, 26 nt, Human
accaguuccggaagaaccugcgggac

SEQ ID NO: 1385816 - RNA, 22 nt, Human
accccaggaccccugcuguccu

SEQ ID NO: 1385817 - RNA, 18 nt, Human
agacugugcucccuuugg

SEQ ID NO: 1385818 - RNA, 19 nt, Human
agcugggugcagacugugc

SEQ ID NO: 1385819 - RNA, 22 nt, Human
aggaccccugcuguccuucccg

SEQ ID NO: 1385820 - RNA, 20 nt, Human
agggauguggcagcugcagu

SEQ ID NO: 1385821 - RNA, 26 nt, Human
caccguaagcccagggauguggcagc

SEQ ID NO: 1385822 - RNA, 20 nt, Human
cagaggcuaaaaccccagga

SEQ ID NO: 1385823 - RNA, 20 nt, Human
cagcagugguacugccuggu

SEQ ID NO: 1385824 - RNA, 19 nt, Human
cccaggaccccugcugucc

SEQ ID NO: 1385825 - RNA, 21 nt, Human
ccuucccgcagcuucuucuug

SEQ ID NO: 1385826 - RNA, 18 nt, Human
cgaugggaugagagcugg

SEQ ID NO: 1385827 - RNA, 19 nt, Human
cuaaaaccccaggaccccu

SEQ ID NO: 1385828 - RNA, 22 nt, Human
cuaaaaccccaggaccccugcu

SEQ ID NO: 1385829 - RNA, 18 nt, Human
cuuccucucuucuucugu

SEQ ID NO: 1385830 - RNA, 18 nt, Human
cuuuucucaaacuuuccu

SEQ ID NO: 1385831 - RNA, 19 nt, Human
gaggcuuggaaacgcuucc

SEQ ID NO: 1385832 - RNA, 21 nt, Human
gcacccacacgcuuagauagc

SEQ ID NO: 1385833 - RNA, 22 nt, Human
gcagcaccucccaguggccaga

SEQ ID NO: 1385834 - RNA, 23 nt, Human
ggcaguuugugguuccugauuug

SEQ ID NO: 1385835 - RNA, 20 nt, Human
ggccagaggcuaaaacccca

SEQ ID NO: 1385836 - RNA, 21 nt, Human
ggugcagacugugcuccccgg

SEQ ID NO: 1385837 - RNA, 20 nt, Human
gugaccucugcagaacuccu

SEQ ID NO: 1385838 - RNA, 22 nt, Human
guucugugacuucccugugacc

SEQ ID NO: 1385839 - RNA, 20 nt, Human
ucccgcagcuucuucuugga

SEQ ID NO: 1385840 - RNA, 22 nt, Human
ucugugacccgggaagcuuugg

SEQ ID NO: 1385841 - RNA, 21 nt, Human
ucuucuguucuucacgcccca

SEQ ID NO: 1385842 - RNA, 18 nt, Human
ugacuucccugugaccuc

SEQ ID NO: 1385843 - RNA, 20 nt, Human
ugcguuuggucuccaggugu

SEQ ID NO: 1385844 - RNA, 22 nt, Human
ugcugcaccguaagcccaggga

SEQ ID NO: 1385845 - RNA, 20 nt, Human
ugggaugagagcugggugca

SEQ ID NO: 1385846 - RNA, 24 nt, Human
ugggugcagacugugcucccuuug

SEQ ID NO: 1385847 - RNA, 24 nt, Human
uguggcagcugcagugggcuuggc

SEQ ID NO: 1385848 - RNA, 23 nt, Human
uuccaguccaaugaaaguuuuau

SEQ ID NO: 1385849 - RNA, 24 nt, Human
uucccauauaaaaauucuucccau

SEQ ID NO: 1385850 - RNA, 19 nt, Human
uuccggaagaaccugcggg

SEQ ID NO: 1385851 - RNA, 20 nt, Human
uucuucuguucuucacgccc

SEQ ID NO: 1385852 - RNA, 27 nt, Human
uugaaaaaagcaccugcugcaccguaa

SEQ ID NO: 1385853 - RNA, 18 nt, Human
uugauuucuucucuggag

SEQ ID NO: 1385854 - RNA, 18 nt, Human
uugguucugugacccggg

SEQ ID NO: 1385855 - RNA, 23 nt, Human
uuuauccgcuuucccauauaaaa

SEQ ID NO: 1385856 - RNA, 24 nt, Human
aacccacucccuuaagcccauuug

SEQ ID NO: 1385857 - RNA, 23 nt, Human
aagcuuacaaagauauaaucuga

SEQ ID NO: 1385858 - RNA, 22 nt, Human
acacacacacucccaggaguuu

SEQ ID NO: 1385859 - RNA, 21 nt, Human
acacacacucccaggaguuua

SEQ ID NO: 1385860 - RNA, 19 nt, Human
acucccuuaagcccauuug

SEQ ID NO: 1385861 - RNA, 18 nt, Human
agacuauuuauuacugcc

SEQ ID NO: 1385862 - RNA, 18 nt, Human
agcaguggcuugugguuc

SEQ ID NO: 1385863 - RNA, 23 nt, Human
agcaguggcuugugguucuccuu

SEQ ID NO: 1385864 - RNA, 25 nt, Human
caacacugcuuuaacugcaucccaa

SEQ ID NO: 1385865 - RNA, 21 nt, Human
cacugcuuuaacugcauccca

SEQ ID NO: 1385866 - RNA, 20 nt, Human
ccuaauccugacccuuggcc

SEQ ID NO: 1385867 - RNA, 21 nt, Human
cggugcuauaaauuucccuca

SEQ ID NO: 1385868 - RNA, 20 nt, Human
cguucaggagcagguuguuc

SEQ ID NO: 1385869 - RNA, 23 nt, Human
cucaacacugcuuuaacugcauc

SEQ ID NO: 1385870 - RNA, 19 nt, Human
cucuugguucucuaguucu

SEQ ID NO: 1385871 - RNA, 22 nt, Human
cucuuuguccucacugguuuca

SEQ ID NO: 1385872 - RNA, 20 nt, Human
cugugggcuaaguggugaua

SEQ ID NO: 1385873 - RNA, 23 nt, Human
gcaaagagcaaaaauauuuugag

SEQ ID NO: 1385874 - RNA, 24 nt, Human
gguggauaagcuuuuugauguucu

SEQ ID NO: 1385875 - RNA, 20 nt, Human
gucguucaggagcagguugu

SEQ ID NO: 1385876 - RNA, 24 nt, Human
guucugcucugaucuugauguuuu

SEQ ID NO: 1385877 - RNA, 23 nt, Human
uaaaacacacacacacucccagg

SEQ ID NO: 1385878 - RNA, 24 nt, Human
uaacugcaucccaaagauucuggu

SEQ ID NO: 1385879 - RNA, 20 nt, Human
uagaagguaaugaacccacu

SEQ ID NO: 1385880 - RNA, 25 nt, Human
uagaagguaaugaacccacucccuu

SEQ ID NO: 1385881 - RNA, 19 nt, Human
uagaauucagcuguaaauc

SEQ ID NO: 1385882 - RNA, 21 nt, Human
uauuuuauucucucuguagca

SEQ ID NO: 1385883 - RNA, 20 nt, Human
ucaggagcagguuguucaau

SEQ ID NO: 1385884 - RNA, 18 nt, Human
uccaugaaggcucuaccc

SEQ ID NO: 1385885 - RNA, 19 nt, Human
ucccucaacacugcuuuaa

SEQ ID NO: 1385886 - RNA, 21 nt, Human
uccucacguggaggaagggau

SEQ ID NO: 1385887 - RNA, 18 nt, Human
uccuuaagcaguggcuug

SEQ ID NO: 1385888 - RNA, 24 nt, Human
ucguucaggagcagguuguucaau

SEQ ID NO: 1385889 - RNA, 18 nt, Human
ucuccuugaaaaggucau

SEQ ID NO: 1385890 - RNA, 19 nt, Human
ucucuaguucuuuuaguug

SEQ ID NO: 1385891 - RNA, 21 nt, Human
ucucuuaaagcuuacaaagau

SEQ ID NO: 1385892 - RNA, 20 nt, Human
ucugcucugaucuugauguu

SEQ ID NO: 1385893 - RNA, 18 nt, Human
ucuuaaagcuuacaaaga

SEQ ID NO: 1385894 - RNA, 23 nt, Human
ugaaggcucuacccucauaacuu

SEQ ID NO: 1385895 - RNA, 18 nt, Human
ugagugaguuucuuaauc

SEQ ID NO: 1385896 - RNA, 23 nt, Human
ugagugaguuucuuaaucuugug

SEQ ID NO: 1385897 - RNA, 19 nt, Human
ugaguuauggagaaauccc

SEQ ID NO: 1385898 - RNA, 23 nt, Human
ugaguuauggagaaaucccuccu

SEQ ID NO: 1385899 - RNA, 22 nt, Human
ugauauacccuuaaccauuuuu

SEQ ID NO: 1385900 - RNA, 18 nt, Human
ugaucgugguggauaagc

SEQ ID NO: 1385901 - RNA, 21 nt, Human
ugaugaagccaacuugaucgu

SEQ ID NO: 1385902 - RNA, 19 nt, Human
ugauguuuuuuuuuuuguc

SEQ ID NO: 1385903 - RNA, 25 nt, Human
ugauuugagaucuuucuaacuuuuu

SEQ ID NO: 1385904 - RNA, 25 nt, Human
ugcaaagagcaaaaauauuuugagc

SEQ ID NO: 1385905 - RNA, 23 nt, Human
ugcuauaaauuucccucaacacu

SEQ ID NO: 1385906 - RNA, 20 nt, Human
uggaggaagggauagaaggu

SEQ ID NO: 1385907 - RNA, 23 nt, Human
ugggaggguguaugugcccagga

SEQ ID NO: 1385908 - RNA, 22 nt, Human
ugggguuuguuugcucuugguu

SEQ ID NO: 1385909 - RNA, 21 nt, Human
ugguagacuauuuauuacugc

SEQ ID NO: 1385910 - RNA, 21 nt, Human
ugugguuuugagugaguuucu

SEQ ID NO: 1385911 - RNA, 24 nt, Human
ugugguuuugagugaguuucuuaa

SEQ ID NO: 1385912 - RNA, 22 nt, Human
uuaagcccauuuguaagagccu

SEQ ID NO: 1385913 - RNA, 24 nt, Human
uuaaggguuuuucauaucucuauc

SEQ ID NO: 1385914 - RNA, 21 nt, Human
uuccuuaagcaguggcuugug

SEQ ID NO: 1385915 - RNA, 21 nt, Human
uuccuuccaugaaggcucuac

SEQ ID NO: 1385916 - RNA, 26 nt, Human
uugauuugagaucuuucuaacuuuuu

SEQ ID NO: 1385917 - RNA, 20 nt, Human
uuggaacaguuucagaagaa

SEQ ID NO: 1385918 - RNA, 18 nt, Human
uugggagaauacauucag

SEQ ID NO: 1385919 - RNA, 21 nt, Human
uugucucuuuguccucacugg

SEQ ID NO: 1385920 - RNA, 19 nt, Human
uuguucaauuuccauguag

SEQ ID NO: 1385921 - RNA, 25 nt, Human
uuuauaguauucucugauggcuguu

SEQ ID NO: 1385922 - RNA, 24 nt, Human
aaagcuuggcugguuuucagauaa

SEQ ID NO: 1385923 - RNA, 20 nt, Human
aacauagugaaaccccgucu

SEQ ID NO: 1385924 - RNA, 21 nt, Human
aacauagugaaaccccgucuc

SEQ ID NO: 1385925 - RNA, 25 nt, Human
aaccacaugggcuccuucaggccuu

SEQ ID NO: 1385926 - RNA, 20 nt, Human
aaccugcuccuuccccaucu

SEQ ID NO: 1385927 - RNA, 22 nt, Human
aacugcacauggggucuccagc

SEQ ID NO: 1385928 - RNA, 20 nt, Human
aacugguguuuuuuuuccuc

SEQ ID NO: 1385929 - RNA, 20 nt, Human
aagcacaaaauauaaacaac

SEQ ID NO: 1385930 - RNA, 21 nt, Human
aagucaguggcaaccaguagc

SEQ ID NO: 1385931 - RNA, 24 nt, Human
aaucacuugaauccgggaggcaga

SEQ ID NO: 1385932 - RNA, 20 nt, Human
aauccuucucaaauucagcc

SEQ ID NO: 1385933 - RNA, 21 nt, Human
aaucuccuucccugugaucuc

SEQ ID NO: 1385934 - RNA, 18 nt, Human
acaccucccagaguaucc

SEQ ID NO: 1385935 - RNA, 23 nt, Human
acaugcaugagacacagcacacg

SEQ ID NO: 1385936 - RNA, 18 nt, Human
accccgucucuacuaaaa

SEQ ID NO: 1385937 - RNA, 18 nt, Human
acuguuggcuucccggag

SEQ ID NO: 1385938 - RNA, 18 nt, Human
acuugaauccgggaggca

SEQ ID NO: 1385939 - RNA, 26 nt, Human
agaacagcaauagacuuucaagagga

SEQ ID NO: 1385940 - RNA, 18 nt, Human
agacaggggaaucacuug

SEQ ID NO: 1385941 - RNA, 24 nt, Human
agacaggggaaucacuugaauccg

SEQ ID NO: 1385942 - RNA, 19 nt, Human
agacaugucauggcugagu

SEQ ID NO: 1385943 - RNA, 21 nt, Human
agacuccuucauccugcagaa

SEQ ID NO: 1385944 - RNA, 18 nt, Human
agagauuggacaugggug

SEQ ID NO: 1385945 - RNA, 22 nt, Human
agagguugcagugagcugagau

SEQ ID NO: 1385946 - RNA, 24 nt, Human
agagguugcagugagcugagaucg

SEQ ID NO: 1385947 - RNA, 24 nt, Human
agagugaagggaagaagugugucg

SEQ ID NO: 1385948 - RNA, 18 nt, Human
agcagcaggagggaagcc

SEQ ID NO: 1385949 - RNA, 22 nt, Human
agcauuuaccuccugcugccag

SEQ ID NO: 1385950 - RNA, 22 nt, Human
agccuggccaacauagugaaac

SEQ ID NO: 1385951 - RNA, 24 nt, Human
agccuggccaacauagugaaaccc

SEQ ID NO: 1385952 - RNA, 23 nt, Human
aggaaaggacaauaccaguaugu

SEQ ID NO: 1385953 - RNA, 20 nt, Human
aggcagagguugcagugagc

SEQ ID NO: 1385954 - RNA, 24 nt, Human
aggcagagguugcagugagcugag

SEQ ID NO: 1385955 - RNA, 20 nt, Human
aggccaaggcgggcggcuca

SEQ ID NO: 1385956 - RNA, 23 nt, Human
aggccaaggcgggcggcucauga

SEQ ID NO: 1385957 - RNA, 24 nt, Human
aggcgggcggcucaugaggucagg

SEQ ID NO: 1385958 - RNA, 24 nt, Human
aggcugagacaggggaaucacuug

SEQ ID NO: 1385959 - RNA, 21 nt, Human
aggugugguggcucacuccug

SEQ ID NO: 1385960 - RNA, 22 nt, Human
aguggccaggugugguggcuca

SEQ ID NO: 1385961 - RNA, 25 nt, Human
auauuuccugaaggccuucagcauc

SEQ ID NO: 1385962 - RNA, 23 nt, Human
caaaagaaagaggccguaaauga

SEQ ID NO: 1385963 - RNA, 24 nt, Human
caacauagugaaaccccgucucua

SEQ ID NO: 1385964 - RNA, 24 nt, Human
caaggcgggcggcucaugagguca

SEQ ID NO: 1385965 - RNA, 21 nt, Human
caccuccaaucuccuucccug

SEQ ID NO: 1385966 - RNA, 22 nt, Human
cacuguaaucccagcuacuugg

SEQ ID NO: 1385967 - RNA, 23 nt, Human
cacuguaaucccagcuacuuggg

SEQ ID NO: 1385968 - RNA, 22 nt, Human
cagcacuuugggaggccaaggc

SEQ ID NO: 1385969 - RNA, 24 nt, Human
cagcacuuugggaggccaaggcgg

SEQ ID NO: 1385970 - RNA, 18 nt, Human
caggagaagaggugagag

SEQ ID NO: 1385971 - RNA, 21 nt, Human
caucugauuuaccaacuguuc

SEQ ID NO: 1385972 - RNA, 22 nt, Human
cauugcauuccaaucccgggug

SEQ ID NO: 1385973 - RNA, 19 nt, Human
ccacugcucucuggaucac

SEQ ID NO: 1385974 - RNA, 23 nt, Human
ccacugcucucuggaucacacug

SEQ ID NO: 1385975 - RNA, 19 nt, Human
ccagcgucucccacugcuc

SEQ ID NO: 1385976 - RNA, 22 nt, Human
ccagcgucucccacugcucucu

SEQ ID NO: 1385977 - RNA, 18 nt, Human
ccaguacccgaugaaccu

SEQ ID NO: 1385978 - RNA, 20 nt, Human
cccaacacuggccucagcau

SEQ ID NO: 1385979 - RNA, 24 nt, Human
cccugugguucuggaagaugaggc

SEQ ID NO: 1385980 - RNA, 21 nt, Human
ccuacugcaaaacuucaagga

SEQ ID NO: 1385981 - RNA, 23 nt, Human
ccucaggacacaucugccucucc

SEQ ID NO: 1385982 - RNA, 23 nt, Human
ccuggccaacauagugaaacccc

SEQ ID NO: 1385983 - RNA, 24 nt, Human
ccuggccaacauagugaaaccccg

SEQ ID NO: 1385984 - RNA, 20 nt, Human
ccugucacgucccagcacuu

SEQ ID NO: 1385985 - RNA, 22 nt, Human
ccugucacgucccagcacuuug

SEQ ID NO: 1385986 - RNA, 23 nt, Human
cgacucacacccuucuuccucaa

SEQ ID NO: 1385987 - RNA, 24 nt, Human
cgagaccagccuggccaacauagu

SEQ ID NO: 1385988 - RNA, 24 nt, Human
cggcucaugaggucaggaguucga

SEQ ID NO: 1385989 - RNA, 24 nt, Human
cgggaggcagagguugcagugagc

SEQ ID NO: 1385990 - RNA, 22 nt, Human
cgggcggcucaugaggucagga

SEQ ID NO: 1385991 - RNA, 20 nt, Human
cuaagucccauuuggccaaa

SEQ ID NO: 1385992 - RNA, 19 nt, Human
cucacuccugucacguccc

SEQ ID NO: 1385993 - RNA, 19 nt, Human
cucauacaccaucgugagc

SEQ ID NO: 1385994 - RNA, 19 nt, Human
cucaugaggucaggaguuc

SEQ ID NO: 1385995 - RNA, 20 nt, Human
cucaugaggucaggaguucc

SEQ ID NO: 1385996 - RNA, 23 nt, Human
cuccaaucuccuucccugugauc

SEQ ID NO: 1385997 - RNA, 20 nt, Human
cuccaucucaaaaaaaaaac

SEQ ID NO: 1385998 - RNA, 24 nt, Human
cucucaguuugaagucaguggccg

SEQ ID NO: 1385999 - RNA, 26 nt, Human
cucuggaucacacugcugggucccag

SEQ ID NO: 1386000 - RNA, 25 nt, Human
cugcaugugcuauuucccaagugcu

SEQ ID NO: 1386001 - RNA, 21 nt, Human
cuguaaucccagcuacuuggg

SEQ ID NO: 1386002 - RNA, 18 nt, Human
cuguucccauuuguuucc

SEQ ID NO: 1386003 - RNA, 19 nt, Human
cuucaggccuugacacgcc

SEQ ID NO: 1386004 - RNA, 24 nt, Human
cuuggcaaaaaaggagcucucaga

SEQ ID NO: 1386005 - RNA, 24 nt, Human
gacacagcacacgacucacacccu

SEQ ID NO: 1386006 - RNA, 23 nt, Human
gagacacagcacacgacucacac

SEQ ID NO: 1386007 - RNA, 24 nt, Human
gagcacagagagcauuuaccuccu

SEQ ID NO: 1386008 - RNA, 20 nt, Human
gaggcccugugguucuggaa

SEQ ID NO: 1386009 - RNA, 18 nt, Human
gaggugucccugagagca

SEQ ID NO: 1386010 - RNA, 22 nt, Human
gaggugucccugagagcacaga

SEQ ID NO: 1386011 - RNA, 22 nt, Human
gagugaagggaagaaguguguc

SEQ ID NO: 1386012 - RNA, 18 nt, Human
gaucacacugcugggucc

SEQ ID NO: 1386013 - RNA, 20 nt, Human
gaugagggaggcucagagaa

SEQ ID NO: 1386014 - RNA, 20 nt, Human
gaugggauucaugaugauca

SEQ ID NO: 1386015 - RNA, 20 nt, Human
gcaaaaaaggagcucucaga

SEQ ID NO: 1386016 - RNA, 20 nt, Human
gcaguuugggaguucugcag

SEQ ID NO: 1386017 - RNA, 20 nt, Human
gcaucagugguagcagcagg

SEQ ID NO: 1386018 - RNA, 23 nt, Human
gcauuccaaucccgggugacugu

SEQ ID NO: 1386019 - RNA, 24 nt, Human
gccaacauagugaaaccccgucuc

SEQ ID NO: 1386020 - RNA, 23 nt, Human
gcggcucaugaggucaggaguuc

SEQ ID NO: 1386021 - RNA, 24 nt, Human
gcucaugaggucaggaguucgaga

SEQ ID NO: 1386022 - RNA, 20 nt, Human
gcugggucccaguacccgau

SEQ ID NO: 1386023 - RNA, 20 nt, Human
ggcaugguggcaggcacugu

SEQ ID NO: 1386024 - RNA, 19 nt, Human
ggccaggugugguggcuca

SEQ ID NO: 1386025 - RNA, 23 nt, Human
ggcgggcggcucaugaggucagg

SEQ ID NO: 1386026 - RNA, 23 nt, Human
ggcugaugggcucagucauggga

SEQ ID NO: 1386027 - RNA, 23 nt, Human
gggaaucacuugaauccgggagg

SEQ ID NO: 1386028 - RNA, 18 nt, Human
gggcggaugagggaggcu

SEQ ID NO: 1386029 - RNA, 24 nt, Human
gggcggcucaugaggucaggaguu

SEQ ID NO: 1386030 - RNA, 22 nt, Human
gggugagcagagggcagggagc

SEQ ID NO: 1386031 - RNA, 26 nt, Human
gguggcucacuccugucacgucccag

SEQ ID NO: 1386032 - RNA, 22 nt, Human
gucccagcacuuugggaggcca

SEQ ID NO: 1386033 - RNA, 19 nt, Human
guccccaacacuggccuca

SEQ ID NO: 1386034 - RNA, 21 nt, Human
guccccaacacuggccucagc

SEQ ID NO: 1386035 - RNA, 20 nt, Human
gugcuauuucccaagugcuc

SEQ ID NO: 1386036 - RNA, 18 nt, Human
gugucccugagagcacag

SEQ ID NO: 1386037 - RNA, 20 nt, Human
guucccauuuguuuccugaa

SEQ ID NO: 1386038 - RNA, 19 nt, Human
guugcagugagcugagauc

SEQ ID NO: 1386039 - RNA, 21 nt, Human
guugcagugagcugagaucgc

SEQ ID NO: 1386040 - RNA, 20 nt, Human
uaaaugaaaagcagcuugga

SEQ ID NO: 1386041 - RNA, 19 nt, Human
uaccaacuguuccucagga

SEQ ID NO: 1386042 - RNA, 19 nt, Human
uaugagacuccaagaaggg

SEQ ID NO: 1386043 - RNA, 25 nt, Human
uauguaggcaaagguccccaacacu

SEQ ID NO: 1386044 - RNA, 19 nt, Human
ucaagaggaggaacucaca

SEQ ID NO: 1386045 - RNA, 24 nt, Human
ucaugaggucaggaguucgagacc

SEQ ID NO: 1386046 - RNA, 19 nt, Human
uccaaucccgggugacugu

SEQ ID NO: 1386047 - RNA, 20 nt, Human
uccaucucaaaaaaaaaacg

SEQ ID NO: 1386048 - RNA, 22 nt, Human
uccccaucuagacacaagcaga

SEQ ID NO: 1386049 - RNA, 19 nt, Human
ucccugagagcacagagag

SEQ ID NO: 1386050 - RNA, 20 nt, Human
ucccugcaugugcuauuucc

SEQ ID NO: 1386051 - RNA, 26 nt, Human
ucccugugaucucaguuccucuuccc

SEQ ID NO: 1386052 - RNA, 21 nt, Human
uccgggaggcagagguugcag

SEQ ID NO: 1386053 - RNA, 23 nt, Human
ucgcgccauugcauuccaauccc

SEQ ID NO: 1386054 - RNA, 20 nt, Human
ucuaacauguguggcucuug

SEQ ID NO: 1386055 - RNA, 19 nt, Human
ucucaguuccucuucccug

SEQ ID NO: 1386056 - RNA, 22 nt, Human
ucuccaggaccucagauuccug

SEQ ID NO: 1386057 - RNA, 24 nt, Human
ucucuacuaaaaaugcaaaaaauu

SEQ ID NO: 1386058 - RNA, 18 nt, Human
ugaauaagcacaaaauau

SEQ ID NO: 1386059 - RNA, 23 nt, Human
ugaauaagcacaaaauauaaaca

SEQ ID NO: 1386060 - RNA, 20 nt, Human
ugagacaggggaaucacuug

SEQ ID NO: 1386061 - RNA, 25 nt, Human
ugagacaggggaaucacuugaaucc

SEQ ID NO: 1386062 - RNA, 20 nt, Human
ugagauucuuggggauggga

SEQ ID NO: 1386063 - RNA, 22 nt, Human
ugagcugagaucgcgccauugc

SEQ ID NO: 1386064 - RNA, 20 nt, Human
ugauuuaccaacuguuccuc

SEQ ID NO: 1386065 - RNA, 20 nt, Human
ugcaaaaaauuagcugggca

SEQ ID NO: 1386066 - RNA, 24 nt, Human
ugcgaguggccaggugugguggcu

SEQ ID NO: 1386067 - RNA, 19 nt, Human
ugcuggagagugcgcaugg

SEQ ID NO: 1386068 - RNA, 20 nt, Human
ugcugggucccaguacccgg

SEQ ID NO: 1386069 - RNA, 22 nt, Human
uggcaaaaaaggagcucucaga

SEQ ID NO: 1386070 - RNA, 23 nt, Human
uggcaaccaguagcauauuuccu

SEQ ID NO: 1386071 - RNA, 21 nt, Human
uggcaggcacuguaaucccag

SEQ ID NO: 1386072 - RNA, 23 nt, Human
uggccaaaauccuuauacuugua

SEQ ID NO: 1386073 - RNA, 25 nt, Human
uggccaggugugguggcucacuccu

SEQ ID NO: 1386074 - RNA, 26 nt, Human
uggcucacuccugucacgucccagca

SEQ ID NO: 1386075 - RNA, 18 nt, Human
uggcugaguuauuuuuug

SEQ ID NO: 1386076 - RNA, 19 nt, Human
uggcuucccggagacuccu

SEQ ID NO: 1386077 - RNA, 21 nt, Human
ugggaggccaaggcgggcggc

SEQ ID NO: 1386078 - RNA, 24 nt, Human
ugggaggccaaggcgggcggcuca

SEQ ID NO: 1386079 - RNA, 24 nt, Human
ugggaggcugagacaggggaauca

SEQ ID NO: 1386080 - RNA, 23 nt, Human
ugggagggaggggaacaccuccc

SEQ ID NO: 1386081 - RNA, 24 nt, Human
uggggaugggauucaugaugauca

SEQ ID NO: 1386082 - RNA, 20 nt, Human
uggggcaggagacccuacug

SEQ ID NO: 1386083 - RNA, 24 nt, Human
uggggcaggagacccuacugcaaa

SEQ ID NO: 1386084 - RNA, 23 nt, Human
ugggugagcagagggcagggagc

SEQ ID NO: 1386085 - RNA, 19 nt, Human
ugguaucaccuccaaucuc

SEQ ID NO: 1386086 - RNA, 23 nt, Human
ugguggcaggcacuguaauccca

SEQ ID NO: 1386087 - RNA, 24 nt, Human
ugguggcaggcacuguaaucccag

SEQ ID NO: 1386088 - RNA, 18 nt, Human
ugguucuggaagaugagg

SEQ ID NO: 1386089 - RNA, 19 nt, Human
ugucccugagagcacagag

SEQ ID NO: 1386090 - RNA, 21 nt, Human
ugucuggagcagaccucagga

SEQ ID NO: 1386091 - RNA, 20 nt, Human
ugucuuguacaaaccccucc

SEQ ID NO: 1386092 - RNA, 18 nt, Human
uguggcucuuggaaacag

SEQ ID NO: 1386093 - RNA, 18 nt, Human
uuagcugggcaugguggc

SEQ ID NO: 1386094 - RNA, 20 nt, Human
uucaaggaaaggacaauacc

SEQ ID NO: 1386095 - RNA, 21 nt, Human
uuccucaacccccuggggcag

SEQ ID NO: 1386096 - RNA, 22 nt, Human
uuccugaaggccuucagcaucc

SEQ ID NO: 1386097 - RNA, 21 nt, Human
uuccuguggcuaccacugucc

SEQ ID NO: 1386098 - RNA, 24 nt, Human
uugaauccgggaggcagagguugc

SEQ ID NO: 1386099 - RNA, 19 nt, Human
uugcagugagcugagaucg

SEQ ID NO: 1386100 - RNA, 22 nt, Human
uugcagugagcugagaucgcgc

SEQ ID NO: 1386101 - RNA, 26 nt, Human
uuggcugguuuucagauaaaaggucu

SEQ ID NO: 1386102 - RNA, 25 nt, Human
uugggaggcugagacaggggaauca

SEQ ID NO: 1386103 - RNA, 21 nt, Human
uuucuggcacuucuccuuguu

SEQ ID NO: 1386104 - RNA, 19 nt, Human
aaagcugccccaaacauac

SEQ ID NO: 1386105 - RNA, 23 nt, Human
aagucagaacauggcacaaaaua

SEQ ID NO: 1386106 - RNA, 22 nt, Human
acaaagcugccccaaacauacu

SEQ ID NO: 1386107 - RNA, 24 nt, Human
acacaucauuuccccuguaacacu

SEQ ID NO: 1386108 - RNA, 21 nt, Human
agcauuuugggaggccaaggc

SEQ ID NO: 1386109 - RNA, 24 nt, Human
aggagaaaagaaucugauugcuug

SEQ ID NO: 1386110 - RNA, 21 nt, Human
aggccaaggcgggcggaucac

SEQ ID NO: 1386111 - RNA, 24 nt, Human
aggcgggcggaucacaaggucagg

SEQ ID NO: 1386112 - RNA, 20 nt, Human
aggcugggugcaguggcuca

SEQ ID NO: 1386113 - RNA, 19 nt, Human
aggugugggcccuggagac

SEQ ID NO: 1386114 - RNA, 24 nt, Human
aguggcucacgccuguaaucccag

SEQ ID NO: 1386115 - RNA, 28 nt, Human
agugugcugagguugcuucaaggcauga

SEQ ID NO: 1386116 - RNA, 24 nt, Human
caaagaacuaacauaagcucaaaa

SEQ ID NO: 1386117 - RNA, 26 nt, Human
caaggcgggcggaucacaaggucagg

SEQ ID NO: 1386118 - RNA, 24 nt, Human
cacgccuguaaucccagcauuuug

SEQ ID NO: 1386119 - RNA, 27 nt, Human
cacugcagaacucauagaacaaaauga

SEQ ID NO: 1386120 - RNA, 23 nt, Human
cagagcagaaaacaauuuaaacc

SEQ ID NO: 1386121 - RNA, 24 nt, Human
cagcauuuugggaggccaaggcgg

SEQ ID NO: 1386122 - RNA, 23 nt, Human
caggugaugagaaggauguagaa

SEQ ID NO: 1386123 - RNA, 22 nt, Human
ccuguaaucccagcauuuuggg

SEQ ID NO: 1386124 - RNA, 21 nt, Human
cucacgccuguaaucccagca

SEQ ID NO: 1386125 - RNA, 21 nt, Human
cucacgccuguaaucccagca

SEQ ID NO: 1386126 - RNA, 25 nt, Human
cucagagcagaaaacaauuuaaacc

SEQ ID NO: 1386127 - RNA, 31 nt, Human
gcccuggagacccucuccuuguagagccucu

SEQ ID NO: 1386128 - RNA, 18 nt, Human
ggcggaucacaaggucag

SEQ ID NO: 1386129 - RNA, 24 nt, Human
gggugcaguggcucacgccuguaa

SEQ ID NO: 1386130 - RNA, 18 nt, Human
gugcaguggcucacgccu

SEQ ID NO: 1386131 - RNA, 25 nt, Human
gugcugagguugcuucaaggcauga

SEQ ID NO: 1386132 - RNA, 25 nt, Human
uaaaaauacagcaaaauuacuccag

SEQ ID NO: 1386133 - RNA, 20 nt, Human
uaauguuaaaaaaugcauag

SEQ ID NO: 1386134 - RNA, 23 nt, Human
uaggaggaacaugaacuguugca

SEQ ID NO: 1386135 - RNA, 23 nt, Human
uaggcugggugcaguggcucacg

SEQ ID NO: 1386136 - RNA, 25 nt, Human
uauaguaucauggaacuucugaggg

SEQ ID NO: 1386137 - RNA, 18 nt, Human
ucacaaggucaggaagau

SEQ ID NO: 1386138 - RNA, 19 nt, Human
ucacaaggucaggaagauu

SEQ ID NO: 1386139 - RNA, 21 nt, Human
ucacgccuguaaucccagcau

SEQ ID NO: 1386140 - RNA, 19 nt, Human
ugaaaugaucaaaguagaa

SEQ ID NO: 1386141 - RNA, 24 nt, Human
ugcagaacucauagaacaaaauga

SEQ ID NO: 1386142 - RNA, 19 nt, Human
ugcuucaaggcaugacuca

SEQ ID NO: 1386143 - RNA, 25 nt, Human
uggaacuucugagucacugcagaac

SEQ ID NO: 1386144 - RNA, 22 nt, Human
uggcucacgccuguaaucccag

SEQ ID NO: 1386145 - RNA, 24 nt, Human
uggcucacgccuguaaucccagca

SEQ ID NO: 1386146 - RNA, 24 nt, Human
ugggaggccaaggcgggcggauca

SEQ ID NO: 1386147 - RNA, 20 nt, Human
ugggaggcuaagugugcuga

SEQ ID NO: 1386148 - RNA, 20 nt, Human
uuaaaagucagaacauggca

SEQ ID NO: 1386149 - RNA, 20 nt, Human
uuacucagagcagaaaacaa

SEQ ID NO: 1386150 - RNA, 21 nt, Human
uucacaaagcugccccaaaca

SEQ ID NO: 1386151 - RNA, 24 nt, Human
aaaaaaagcaacguucucuacaaa

SEQ ID NO: 1386152 - RNA, 23 nt, Human
aaaaacuggcaaguacuucugaa

SEQ ID NO: 1386153 - RNA, 20 nt, Human
aaaaagcaacguucucuaca

SEQ ID NO: 1386154 - RNA, 22 nt, Human
aaaacuaaacaacaauaaaaac

SEQ ID NO: 1386155 - RNA, 24 nt, Human
aaaacuaaacaacaauaaaaaccc

SEQ ID NO: 1386156 - RNA, 21 nt, Human
aaaauaaauaaucacaaaaac

SEQ ID NO: 1386157 - RNA, 19 nt, Human
aaacaacaauaaaaaccca

SEQ ID NO: 1386158 - RNA, 25 nt, Human
aaaccaaaacuaaacaacaauaaaa

SEQ ID NO: 1386159 - RNA, 21 nt, Human
aaacgaagacauaccccaaag

SEQ ID NO: 1386160 - RNA, 23 nt, Human
aaacuugaagacugcuauaaacc

SEQ ID NO: 1386161 - RNA, 18 nt, Human
aaagagcuagccaauuuc

SEQ ID NO: 1386162 - RNA, 24 nt, Human
aaaugaccugauuuuccuaaaaac

SEQ ID NO: 1386163 - RNA, 20 nt, Human
aagaaaaacuguuaaaucac

SEQ ID NO: 1386164 - RNA, 20 nt, Human
aagaagcagaaagcuacacg

SEQ ID NO: 1386165 - RNA, 21 nt, Human
acacaaaaauugcucacugca

SEQ ID NO: 1386166 - RNA, 18 nt, Human
accagaauaagcaaaucu

SEQ ID NO: 1386167 - RNA, 20 nt, Human
accccaaagagaaggaaaca

SEQ ID NO: 1386168 - RNA, 24 nt, Human
acuuugugaauacacuaaaaacca

SEQ ID NO: 1386169 - RNA, 27 nt, Human
agaaacgaagacauaccccaaagagaa

SEQ ID NO: 1386170 - RNA, 22 nt, Human
agaaagcuacacggaaaaaggu

SEQ ID NO: 1386171 - RNA, 22 nt, Human
agaaauguugagcuuccuacag

SEQ ID NO: 1386172 - RNA, 20 nt, Human
agaagaaaacaguagccaag

SEQ ID NO: 1386173 - RNA, 21 nt, Human
agaagcgaaggacggcggagc

SEQ ID NO: 1386174 - RNA, 23 nt, Human
agaauaagcaaaucuacagagag

SEQ ID NO: 1386175 - RNA, 23 nt, Human
agcuacggggaagcgaagaggaa

SEQ ID NO: 1386176 - RNA, 18 nt, Human
agggcugugagaaaacgg

SEQ ID NO: 1386177 - RNA, 27 nt, Human
aggggcucggggauggggugggcacug

SEQ ID NO: 1386178 - RNA, 21 nt, Human
agucaguguuccgcagacaga

SEQ ID NO: 1386179 - RNA, 22 nt, Human
agugaagauggaaaacuugaag

SEQ ID NO: 1386180 - RNA, 20 nt, Human
aucaucaucacuuuaacccg

SEQ ID NO: 1386181 - RNA, 19 nt, Human
augaaauaccaaagacuca

SEQ ID NO: 1386182 - RNA, 23 nt, Human
caaaaauuguagugcaaaagaaa

SEQ ID NO: 1386183 - RNA, 20 nt, Human
caaaacacagcagucacaca

SEQ ID NO: 1386184 - RNA, 22 nt, Human
caaaacaguggcuuuuacaaaa

SEQ ID NO: 1386185 - RNA, 25 nt, Human
caaaacuaaacaacaauaaaaaccc

SEQ ID NO: 1386186 - RNA, 19 nt, Human
caaaagaagcgaaggacgg

SEQ ID NO: 1386187 - RNA, 21 nt, Human
caaaagaagcgaaggacggcg

SEQ ID NO: 1386188 - RNA, 22 nt, Human
caaaccaaaacuaaacaacaau

SEQ ID NO: 1386189 - RNA, 18 nt, Human
caaaugaagagaacacaa

SEQ ID NO: 1386190 - RNA, 21 nt, Human
caacaauaaaaacccaaugaa

SEQ ID NO: 1386191 - RNA, 18 nt, Human
caauuccuuugaacucug

SEQ ID NO: 1386192 - RNA, 23 nt, Human
cacaagaaaaacuguuaaaucac

SEQ ID NO: 1386193 - RNA, 24 nt, Human
cacaagaaaaacuguuaaaucacc

SEQ ID NO: 1386194 - RNA, 21 nt, Human
cacacagaaucucagagaaau

SEQ ID NO: 1386195 - RNA, 22 nt, Human
cacuauauaaucaauuagggaa

SEQ ID NO: 1386196 - RNA, 19 nt, Human
cagaaagaugacgucacug

SEQ ID NO: 1386197 - RNA, 26 nt, Human
cagcaaaagaagcgaaggacggcgga

SEQ ID NO: 1386198 - RNA, 18 nt, Human
cagcagucacacaguauu

SEQ ID NO: 1386199 - RNA, 20 nt, Human
cagcccagcaaaagaagcga

SEQ ID NO: 1386200 - RNA, 20 nt, Human
cagugguggaaaagccagag

SEQ ID NO: 1386201 - RNA, 25 nt, Human
cauaccccaaagagaaggaaacaag

SEQ ID NO: 1386202 - RNA, 20 nt, Human
caucagggaaguccauuugu

SEQ ID NO: 1386203 - RNA, 18 nt, Human
ccauuuauaugaaaugac

SEQ ID NO: 1386204 - RNA, 23 nt, Human
ccgaaggagcagcagcccagcaa

SEQ ID NO: 1386205 - RNA, 22 nt, Human
ccgcagacagacugggcuggcg

SEQ ID NO: 1386206 - RNA, 22 nt, Human
ccuaaagcacauuuccuuuuca

SEQ ID NO: 1386207 - RNA, 21 nt, Human
cgagaacccacgaaccugcgc

SEQ ID NO: 1386208 - RNA, 22 nt, Human
cgagaacccacgaaccugcgcu

SEQ ID NO: 1386209 - RNA, 24 nt, Human
cgagaacccacgaaccugcgcuau

SEQ ID NO: 1386210 - RNA, 22 nt, Human
cgcuauggaggccucucuagga

SEQ ID NO: 1386211 - RNA, 21 nt, Human
cggcaaaugggggcagggcca

SEQ ID NO: 1386212 - RNA, 18 nt, Human
cguaacaaaccaaaacua

SEQ ID NO: 1386213 - RNA, 23 nt, Human
cuccaauauuccagcucuguguc

SEQ ID NO: 1386214 - RNA, 20 nt, Human
cugcucaaggguacaggguu

SEQ ID NO: 1386215 - RNA, 19 nt, Human
gaaaaacuguuaaaucacc

SEQ ID NO: 1386216 - RNA, 19 nt, Human
gaaaacuugaagacugcua

SEQ ID NO: 1386217 - RNA, 18 nt, Human
gaagacauaccccaaaga

SEQ ID NO: 1386218 - RNA, 21 nt, Human
gaagauggaaaacuugaagac

SEQ ID NO: 1386219 - RNA, 19 nt, Human
gaagcagaaagcuacacgg

SEQ ID NO: 1386220 - RNA, 24 nt, Human
gagaaaaugagaggugaccgguac

SEQ ID NO: 1386221 - RNA, 19 nt, Human
gaggaguguuuuauacccc

SEQ ID NO: 1386222 - RNA, 25 nt, Human
gaggcucuuccaaaccaaaucguac

SEQ ID NO: 1386223 - RNA, 20 nt, Human
gauggaaaacuugaagacug

SEQ ID NO: 1386224 - RNA, 21 nt, Human
gauggaaaacuugaagacugc

SEQ ID NO: 1386225 - RNA, 21 nt, Human
gcaaaagaaaagaaaucuaaa

SEQ ID NO: 1386226 - RNA, 20 nt, Human
gcgccggcaaaugggggcag

SEQ ID NO: 1386227 - RNA, 19 nt, Human
ggaaaaagguccgcgagaa

SEQ ID NO: 1386228 - RNA, 24 nt, Human
ggaaacaggaaugccgggaagaaa

SEQ ID NO: 1386229 - RNA, 26 nt, Human
ggcccaauuccuuugaacucugucuu

SEQ ID NO: 1386230 - RNA, 22 nt, Human
gggccggagcccaacggaguca

SEQ ID NO: 1386231 - RNA, 22 nt, Human
gggcgccggcaaaugggggcag

SEQ ID NO: 1386232 - RNA, 20 nt, Human
ggggauggggugggcacugg

SEQ ID NO: 1386233 - RNA, 20 nt, Human
uaaaaugccuacaaguacaa

SEQ ID NO: 1386234 - RNA, 19 nt, Human
uaaacagaguuugaaucag

SEQ ID NO: 1386235 - RNA, 21 nt, Human
uaaaccagaaacuacaaaaca

SEQ ID NO: 1386236 - RNA, 20 nt, Human
uaaauaaucacaaaaaccac

SEQ ID NO: 1386237 - RNA, 18 nt, Human
uaacaaaccaaaacuaaa

SEQ ID NO: 1386238 - RNA, 21 nt, Human
uaacaaaccaaaacuaaacaa

SEQ ID NO: 1386239 - RNA, 23 nt, Human
uaagaaacgaagacauaccccaa

SEQ ID NO: 1386240 - RNA, 18 nt, Human
uaagcaaaucuacagaga

SEQ ID NO: 1386241 - RNA, 24 nt, Human
uacacuaaaaaccacuaaauugua

SEQ ID NO: 1386242 - RNA, 21 nt, Human
uacaguaaguugagccuguua

SEQ ID NO: 1386243 - RNA, 20 nt, Human
uacagugaagauggaaaacu

SEQ ID NO: 1386244 - RNA, 26 nt, Human
uaccccaaacuccaauauuccagcuc

SEQ ID NO: 1386245 - RNA, 21 nt, Human
uaccuguacaauccaaaaaaa

SEQ ID NO: 1386246 - RNA, 24 nt, Human
uacuauaauucaugcugcaaaaca

SEQ ID NO: 1386247 - RNA, 19 nt, Human
uaguaugaaauaaacagag

SEQ ID NO: 1386248 - RNA, 21 nt, Human
uagugguugccaggggcucgg

SEQ ID NO: 1386249 - RNA, 22 nt, Human
uauaugaaauaccaaagacuca

SEQ ID NO: 1386250 - RNA, 23 nt, Human
uaucaacucuguauccucauccu

SEQ ID NO: 1386251 - RNA, 24 nt, Human
ucauuagagagcagagucaguguu

SEQ ID NO: 1386252 - RNA, 18 nt, Human
ucugaagcagagccacuu

SEQ ID NO: 1386253 - RNA, 19 nt, Human
ucugacaaagaauuucuga

SEQ ID NO: 1386254 - RNA, 22 nt, Human
ucugauggaaggagcuuguuuc

SEQ ID NO: 1386255 - RNA, 22 nt, Human
ucuuaugacucaugccuaaagc

SEQ ID NO: 1386256 - RNA, 20 nt, Human
ugaaauaccaaagacucauu

SEQ ID NO: 1386257 - RNA, 20 nt, Human
ugacugcucaaggguacagg

SEQ ID NO: 1386258 - RNA, 20 nt, Human
ugagaaaacggaaacaggaa

SEQ ID NO: 1386259 - RNA, 25 nt, Human
ugcauacaguuauucccuuuuuaca

SEQ ID NO: 1386260 - RNA, 21 nt, Human
ugccuacaaguacaauggcau

SEQ ID NO: 1386261 - RNA, 18 nt, Human
ugcuauaaaccagaaacu

SEQ ID NO: 1386262 - RNA, 20 nt, Human
uggaaaacuugaagacugcu

SEQ ID NO: 1386263 - RNA, 21 nt, Human
uggaggccucucuaggagggc

SEQ ID NO: 1386264 - RNA, 22 nt, Human
uggcaaguacuucugaagcaga

SEQ ID NO: 1386265 - RNA, 18 nt, Human
uggcuaaugacaauuuuc

SEQ ID NO: 1386266 - RNA, 22 nt, Human
uguucugacaaagaauuucuga

SEQ ID NO: 1386267 - RNA, 24 nt, Human
uuagggaaauuuuuacagacaaau

SEQ ID NO: 1386268 - RNA, 21 nt, Human
uugagcuuccuacagcucucu

SEQ ID NO: 1386269 - RNA, 22 nt, Human
uuuccaaaaggauuccaaaaau

SEQ ID NO: 1386270 - RNA, 23 nt, Human
uuuuacaaaagauguggauuugu

SEQ ID NO: 1386271 - RNA, 19 nt, Human
caggucaagugaauagcga

SEQ ID NO: 1386272 - RNA, 22 nt, Human
ccauaaguuuuugcuucugcag

SEQ ID NO: 1386273 - RNA, 20 nt, Human
gguucuccaggucaagugaa

SEQ ID NO: 1386274 - RNA, 22 nt, Human
uaaguuuuugcuucugcaguuu

SEQ ID NO: 1386275 - RNA, 19 nt, Human
uaccucaggcugcuuaggg

SEQ ID NO: 1386276 - RNA, 19 nt, Human
uaucuuuuucuucugggca

SEQ ID NO: 1386277 - RNA, 25 nt, Human
ucuucugggcaaccuccucuucugg

SEQ ID NO: 1386278 - RNA, 21 nt, Human
ugcuucugcaguuucuucugg

SEQ ID NO: 1386279 - RNA, 23 nt, Human
uucuucugggcaaccuccucuuc

SEQ ID NO: 1386280 - RNA, 23 nt, Human
uuuuuuuuuuuuuuuuuuccuuu

SEQ ID NO: 1386281 - RNA, 24 nt, Human
uuuuuuuuuuuuuuuuuuccuuuu

SEQ ID NO: 1386282 - RNA, 25 nt, Human
uuuuuuuuuuuuuuuuuuuuccuuu

SEQ ID NO: 1386283 - RNA, 25 nt, Human
uuuuuuuuuuuuuuuuuuuuuccuu

SEQ ID NO: 1386284 - RNA, 30 nt, Human; identical to SEQ ID NO: 345631

SEQ ID NO: 1386285 - RNA, 23 nt, Human
aaaaaguucccuuaucccguuca

SEQ ID NO: 1386286 - RNA, 21 nt, Human
aaacucuguuucuacaaaaaa

SEQ ID NO: 1386287 - RNA, 21 nt, Human
aaaguucccuuaucccguuca

SEQ ID NO: 1386288 - RNA, 18 nt, Human
aacauggugaaacucugu

SEQ ID NO: 1386289 - RNA, 21 nt, Human
aacauggugaaacucuguuuc

SEQ ID NO: 1386290 - RNA, 23 nt, Human
aaccguaggacaagggaagcccc

SEQ ID NO: 1386291 - RNA, 18 nt, Human
aauugcuugaacccguga

SEQ ID NO: 1386292 - RNA, 25 nt, Human
agacaggcaggcuauggccucgugc

SEQ ID NO: 1386293 - RNA, 18 nt, Human
agagguugcagugagccg

SEQ ID NO: 1386294 - RNA, 23 nt, Human
agagguugcagugagccgagauc

SEQ ID NO: 1386295 - RNA, 24 nt, Human
agagguugcagugagccgagauca

SEQ ID NO: 1386296 - RNA, 24 nt, Human
agcacuuugggaggccgaggaggg

SEQ ID NO: 1386297 - RNA, 19 nt, Human
agcauuauuuauucuugcu

SEQ ID NO: 1386298 - RNA, 22 nt, Human
agccuaagcaacauggugaaac

SEQ ID NO: 1386299 - RNA, 24 nt, Human
agccugggcgacagagccagacuc

SEQ ID NO: 1386300 - RNA, 20 nt, Human
agcuugggaggcugaggcag

SEQ ID NO: 1386301 - RNA, 18 nt, Human
aggagggaggaucacuug

SEQ ID NO: 1386302 - RNA, 24 nt, Human
aggaucacuugaggccaggaguuu

SEQ ID NO: 1386303 - RNA, 21 nt, Human
aggcagagguugcagugagcc

SEQ ID NO: 1386304 - RNA, 24 nt, Human
aggcagagguugcagugagccgag

SEQ ID NO: 1386305 - RNA, 24 nt, Human
aggcaggagaauugcuugaacccg

SEQ ID NO: 1386306 - RNA, 21 nt, Human
aggcugaggcaggagaauugc

SEQ ID NO: 1386307 - RNA, 24 nt, Human
aggcugaggcaggagaauugcuug

SEQ ID NO: 1386308 - RNA, 21 nt, Human
agucaggcauaguggugaagc

SEQ ID NO: 1386309 - RNA, 20 nt, Human
aucacuugaggccaggaguu

SEQ ID NO: 1386310 - RNA, 24 nt, Human
aucaugccauugcgcuccagccug

SEQ ID NO: 1386311 - RNA, 24 nt, Human
auugcgcuccagccugggcgacag

SEQ ID NO: 1386312 - RNA, 24 nt, Human
caacauggugaaacucuguuucua

SEQ ID NO: 1386313 - RNA, 24 nt, Human
cacaccccacaacaguguuugcug

SEQ ID NO: 1386314 - RNA, 23 nt, Human
cagcacuuugggaggccgaggag

SEQ ID NO: 1386315 - RNA, 24 nt, Human
cagcacuuugggaggccgaggagg

SEQ ID NO: 1386316 - RNA, 19 nt, Human
cauugcgcuccagccuggg

SEQ ID NO: 1386317 - RNA, 21 nt, Human
cauugcgcuccagccugggcg

SEQ ID NO: 1386318 - RNA, 22 nt, Human
cauugcgcuccagccugggcga

SEQ ID NO: 1386319 - RNA, 24 nt, Human
cauugcgcuccagccugggcgaca

SEQ ID NO: 1386320 - RNA, 20 nt, Human
ccauugcgcuccagccuggg

SEQ ID NO: 1386321 - RNA, 21 nt, Human
ccauugcgcuccagccugggc

SEQ ID NO: 1386322 - RNA, 22 nt, Human
ccauugcgcuccagccugggcg

SEQ ID NO: 1386323 - RNA, 24 nt, Human
ccauugcgcuccagccugggcgac

SEQ ID NO: 1386324 - RNA, 22 nt, Human
ccccacaacaguguuugcugcc

SEQ ID NO: 1386325 - RNA, 23 nt, Human
ccccacaacaguguuugcugccc

SEQ ID NO: 1386326 - RNA, 20 nt, Human
ccuaagcaacauggugaaac

SEQ ID NO: 1386327 - RNA, 18 nt, Human
ccucuaggcggaccaugc

SEQ ID NO: 1386328 - RNA, 18 nt, Human
ccucuaggcggaccaugc

SEQ ID NO: 1386329 - RNA, 26 nt, Human
ccugucacaccccacaacaguguuug

SEQ ID NO: 1386330 - RNA, 24 nt, Human
cuggcggugccuucugcucuuuuc

SEQ ID NO: 1386331 - RNA, 23 nt, Human
cugggacugaucaaacauggaga

SEQ ID NO: 1386332 - RNA, 24 nt, Human
gaucacuugaggccaggaguuuga

SEQ ID NO: 1386333 - RNA, 20 nt, Human
gcaacauggugaaacucugu

SEQ ID NO: 1386334 - RNA, 22 nt, Human
gccauugcgcuccagccugggc

SEQ ID NO: 1386335 - RNA, 24 nt, Human
gccauugcgcuccagccugggcga

SEQ ID NO: 1386336 - RNA, 19 nt, Human
gccuguaaucccagcacuu

SEQ ID NO: 1386337 - RNA, 24 nt, Human
gcgcuccagccugggcgacagagc

SEQ ID NO: 1386338 - RNA, 19 nt, Human
ggaucacuugaggccagga

SEQ ID NO: 1386339 - RNA, 22 nt, Human
ggaucacuugaggccaggaguu

SEQ ID NO: 1386340 - RNA, 19 nt, Human
ggccaggaguuugagacca

SEQ ID NO: 1386341 - RNA, 18 nt, Human
ggccgaggagggaggauc

SEQ ID NO: 1386342 - RNA, 23 nt, Human
ggcgacagagccagacucucuuu

SEQ ID NO: 1386343 - RNA, 18 nt, Human
gggcaugcgaugggggug

SEQ ID NO: 1386344 - RNA, 24 nt, Human
ggugccuguaaucccagcacuuug

SEQ ID NO: 1386345 - RNA, 19 nt, Human
guaggacaagggaagccuu

SEQ ID NO: 1386346 - RNA, 20 nt, Human
gugaggcagagguugcagug

SEQ ID NO: 1386347 - RNA, 23 nt, Human
gugaggcagagguugcagugagc

SEQ ID NO: 1386348 - RNA, 24 nt, Human
guugcagugagccgagaucaugcc

SEQ ID NO: 1386349 - RNA, 23 nt, Human
ucacuugaggccaggaguuugag

SEQ ID NO: 1386350 - RNA, 23 nt, Human
ucaugccauugcgcuccagccug

SEQ ID NO: 1386351 - RNA, 24 nt, Human
uccagccugggcgacagagccaga

SEQ ID NO: 1386352 - RNA, 23 nt, Human
ucggugccuguaaucccagcacu

SEQ ID NO: 1386353 - RNA, 20 nt, Human
ucugcucuuuuccgagcucu

SEQ ID NO: 1386354 - RNA, 23 nt, Human
ucugcucuuuuccgagcucuucu

SEQ ID NO: 1386355 - RNA, 21 nt, Human
ucuugcuuuguccccaaccgu

SEQ ID NO: 1386356 - RNA, 24 nt, Human
ugaaagcuugggaggcugaggcag

SEQ ID NO: 1386357 - RNA, 22 nt, Human
ugagccgagaucaugccauugc

SEQ ID NO: 1386358 - RNA, 23 nt, Human
ugaggcagagguugcagugagcc

SEQ ID NO: 1386359 - RNA, 24 nt, Human
ugaggcaggagaauugcuugaacc

SEQ ID NO: 1386360 - RNA, 25 nt, Human
ugaggcaggagaauugcuugaaccc

SEQ ID NO: 1386361 - RNA, 22 nt, Human
ugcaagagcucccugucacacc

SEQ ID NO: 1386362 - RNA, 23 nt, Human
ugccuguaaucccagcacuuugg

SEQ ID NO: 1386363 - RNA, 23 nt, Human
ugccuguaaucccagcacuuugg

SEQ ID NO: 1386364 - RNA, 24 nt, Human
ugccuguaaucccagcacuuuggg

SEQ ID NO: 1386365 - RNA, 22 nt, Human
ugcgcuccagccugggcgacag

SEQ ID NO: 1386366 - RNA, 24 nt, Human
ugcgcuccagccugggcgacagag

SEQ ID NO: 1386367 - RNA, 24 nt, Human
uggcugcaagagcucccugucaca

SEQ ID NO: 1386368 - RNA, 18 nt, Human
ugggaggccgaggaggga

SEQ ID NO: 1386369 - RNA, 24 nt, Human
ugggaggccgaggagggaggauca

SEQ ID NO: 1386370 - RNA, 19 nt, Human
ugggaggcugaggcaggag

SEQ ID NO: 1386371 - RNA, 22 nt, Human
ugggaggcugaggcaggagaau

SEQ ID NO: 1386372 - RNA, 22 nt, Human
uuagcauuauuuauucuugcuu

SEQ ID NO: 1386373 - RNA, 24 nt, Human
uucucggugccuguaaucccagca

SEQ ID NO: 1386374 - RNA, 19 nt, Human
uucuuccaugcccagcugc

SEQ ID NO: 1386375 - RNA, 22 nt, Human
uugaggccaggaguuugagacc

SEQ ID NO: 1386376 - RNA, 20 nt, Human
uugcagugagccgagaucau

SEQ ID NO: 1386377 - RNA, 21 nt, Human
uugcagugagccgagaucaug

SEQ ID NO: 1386378 - RNA, 18 nt, Human
uugcuugaacccgugagg

SEQ ID NO: 1386379 - RNA, 19 nt, Human
uugcuuuguccccaaccgu

SEQ ID NO: 1386380 - RNA, 25 nt, Human
uugggaggccgaggagggaggauca

SEQ ID NO: 1386381 - RNA, 23 nt, Human
uugggaggcugaggcaggagaau

SEQ ID NO: 1386382 - RNA, 20 nt, Human
uuuuuuuuuuucagaccuca

SEQ ID NO: 1386383 - RNA, 22 nt, Human
uuuuuuuuuuuuuuuuuuucag

SEQ ID NO: 1386384 - RNA, 23 nt, Human
aacccaguccuccucguccucca

SEQ ID NO: 1386385 - RNA, 23 nt, Human
acguguccugccaguagcuguug

SEQ ID NO: 1386386 - RNA, 22 nt, Human
acuuccacuugauuuaaaaguc

SEQ ID NO: 1386387 - RNA, 20 nt, Human
agcuguagaugccgagccgg

SEQ ID NO: 1386388 - RNA, 19 nt, Human
caaaggccuuuuauucauu

SEQ ID NO: 1386389 - RNA, 19 nt, Human
cauggaaacagugcucugc

SEQ ID NO: 1386390 - RNA, 24 nt, Human
ccaauaaaagcuaaaguuccuucu

SEQ ID NO: 1386391 - RNA, 19 nt, Human
ccaggccgcguucccuggg

SEQ ID NO: 1386392 - RNA, 19 nt, Human
cccgcggacccucagccgg

SEQ ID NO: 1386393 - RNA, 19 nt, Human
cccugggucccgcggaccc

SEQ ID NO: 1386394 - RNA, 20 nt, Human
cccugggucccgcggacccu

SEQ ID NO: 1386395 - RNA, 23 nt, Human
cuccaggccgcguucccuggguc

SEQ ID NO: 1386396 - RNA, 23 nt, Human
cuuuuuuuuucacaugaauaggu

SEQ ID NO: 1386397 - RNA, 20 nt, Human
uaaaauguggugucuucauu

SEQ ID NO: 1386398 - RNA, 26 nt, Human
ucaaaggccuuuuauucauuaacuga

SEQ ID NO: 1386399 - RNA, 22 nt, Human
ucgucuguccuggacugacuga

SEQ ID NO: 1386400 - RNA, 18 nt, Human
ucugcagugagccucucu

SEQ ID NO: 1386401 - RNA, 19 nt, Human
ugaauaggugaacuguguc

SEQ ID NO: 1386402 - RNA, 21 nt, Human
uguccuggacugacugaagaa

SEQ ID NO: 1386403 - RNA, 22 nt, Human
uguggugaaccaauaaaagcua

SEQ ID NO: 1386404 - RNA, 20 nt, Human
uuaaaagucauguuugauag

SEQ ID NO: 1386405 - RNA, 21 nt, Human
uuauucauuaacugaacaauc

SEQ ID NO: 1386406 - RNA, 25 nt, Human
uugccaguuuguuuaagacagguau

SEQ ID NO: 1386407 - RNA, 19 nt, Human
uuuuuuuuuuuuuaaggga

SEQ ID NO: 1386408 - RNA, 24 nt, Human
uuuuuuuuuuuuuuuuuuuaaggg

SEQ ID NO: 1386409 - RNA, 19 nt, Human
cuaugcuguaucucucccu

SEQ ID NO: 1386410 - RNA, 26 nt, Human
cuguaucucucccucagcaauucaua

SEQ ID NO: 1386411 - RNA, 19 nt, Human
ucaucugaaaauuuggcgu

SEQ ID NO: 1386412 - RNA, 19 nt, Human
uucuaugcuguaucucucc

SEQ ID NO: 1386413 - RNA, 25 nt, Human
aaaagccucccaccuguucucccag

SEQ ID NO: 1386414 - RNA, 18 nt, Human
aacagcuucccuaagugu

SEQ ID NO: 1386415 - RNA, 26 nt, Human
aacauacacacgcacaaacuugcaca

SEQ ID NO: 1386416 - RNA, 21 nt, Human
aagaacuagaacauaauggaa

SEQ ID NO: 1386417 - RNA, 23 nt, Human
aagcaggaacgcugcaaggucua

SEQ ID NO: 1386418 - RNA, 29 nt, Human
acauacacacgcacaaacuugcacaugca

SEQ ID NO: 1386419 - RNA, 22 nt, Human
accucauucugcccccaaccag

SEQ ID NO: 1386420 - RNA, 19 nt, Human
agaauggaaggaggguagg

SEQ ID NO: 1386421 - RNA, 21 nt, Human
agagaugggcuccgggcuucu

SEQ ID NO: 1386422 - RNA, 18 nt, Human
aggcaggugaacuccagg

SEQ ID NO: 1386423 - RNA, 19 nt, Human
aggcaggugaacuccagga

SEQ ID NO: 1386424 - RNA, 20 nt, Human
agggaggggaacgcagucug

SEQ ID NO: 1386425 - RNA, 21 nt, Human
aucaugggccguagcugaagu

SEQ ID NO: 1386426 - RNA, 24 nt, Human
aucucauucucccuagguauccaa

SEQ ID NO: 1386427 - RNA, 31 nt, Human
auggaacacugcuguggaaaaaagauaccag

SEQ ID NO: 1386428 - RNA, 22 nt, Human
caaggauuuccuugagaagcuc

SEQ ID NO: 1386429 - RNA, 19 nt, Human
caaucauucaaucaaccag

SEQ ID NO: 1386430 - RNA, 22 nt, Human
cacagggcuggcuggagaugcc

SEQ ID NO: 1386431 - RNA, 22 nt, Human
cacauaaaucauuucccaaauc

SEQ ID NO: 1386432 - RNA, 26 nt, Human
cacccacaaugaguuccacaaucauu

SEQ ID NO: 1386433 - RNA, 21 nt, Human
cacccagaucccuccaggagu

SEQ ID NO: 1386434 - RNA, 22 nt, Human
cagcuuccuggaugcacaggga

SEQ ID NO: 1386435 - RNA, 19 nt, Human
caggaauucucugguccag

SEQ ID NO: 1386436 - RNA, 18 nt, Human
cauacacacgcacaaacu

SEQ ID NO: 1386437 - RNA, 24 nt, Human
caucaugggccguagcugaagugg

SEQ ID NO: 1386438 - RNA, 25 nt, Human
ccacaggggcugcucugugcuccuc

SEQ ID NO: 1386439 - RNA, 22 nt, Human
ccacccacaaugaguuccacaa

SEQ ID NO: 1386440 - RNA, 19 nt, Human
ccacugggaagaacacaga

SEQ ID NO: 1386441 - RNA, 19 nt, Human
ccauauccuuccaucaaau

SEQ ID NO: 1386442 - RNA, 19 nt, Human
cccagaucccuccaggagu

SEQ ID NO: 1386443 - RNA, 18 nt, Human
cccccaaccagauggggg

SEQ ID NO: 1386444 - RNA, 22 nt, Human
ccuagguauccaacaucggcau

SEQ ID NO: 1386445 - RNA, 22 nt, Human
ccucccaccuguucucccagac

SEQ ID NO: 1386446 - RNA, 22 nt, Human
ccuucuccauauccuuccauca

SEQ ID NO: 1386447 - RNA, 20 nt, Human
ccuugagaagcucuaagggg

SEQ ID NO: 1386448 - RNA, 22 nt, Human
cgacgcuccaccauucucuagg

SEQ ID NO: 1386449 - RNA, 21 nt, Human
cuaacagccagggaggggaac

SEQ ID NO: 1386450 - RNA, 21 nt, Human
cuccaggaucuuacaaucuac

SEQ ID NO: 1386451 - RNA, 22 nt, Human
cucccaccuguucucccagacc

SEQ ID NO: 1386452 - RNA, 25 nt, Human
cuuccaaaacauacacacgcacaaa

SEQ ID NO: 1386453 - RNA, 21 nt, Human
gaaggaggguaggaaucccca

SEQ ID NO: 1386454 - RNA, 18 nt, Human
gcugaaaugcauagccca

SEQ ID NO: 1386455 - RNA, 18 nt, Human
gcugcagaagccacaaaa

SEQ ID NO: 1386456 - RNA, 19 nt, Human
ggagagaugggcuccgggc

SEQ ID NO: 1386457 - RNA, 23 nt, Human
ggagaugggcuuuguaaccucau

SEQ ID NO: 1386458 - RNA, 19 nt, Human
ggguaggugggaaaaagua

SEQ ID NO: 1386459 - RNA, 18 nt, Human
guuuccacacuccacagg

SEQ ID NO: 1386460 - RNA, 23 nt, Human
uaagugccuucaccugggguucu

SEQ ID NO: 1386461 - RNA, 19 nt, Human
uaagugugcggcuuauugc

SEQ ID NO: 1386462 - RNA, 20 nt, Human
uauuacaggacuucucagag

SEQ ID NO: 1386463 - RNA, 20 nt, Human
ucaagaacuagaacauaaug

SEQ ID NO: 1386464 - RNA, 19 nt, Human
ucacagggcuggcuggaga

SEQ ID NO: 1386465 - RNA, 19 nt, Human
ucaccugggguucuaugcc

SEQ ID NO: 1386466 - RNA, 24 nt, Human
ucaggguuugguguuuccacacuc

SEQ ID NO: 1386467 - RNA, 25 nt, Human
ucaguggccuucuccauauccuucc

SEQ ID NO: 1386468 - RNA, 21 nt, Human
ucaguucacccauccaugucc

SEQ ID NO: 1386469 - RNA, 19 nt, Human
ucccuaagugugcggcuua

SEQ ID NO: 1386470 - RNA, 22 nt, Human
ucucaaacuauugucucugcca

SEQ ID NO: 1386471 - RNA, 20 nt, Human
ucuccauauccuuccaucaa

SEQ ID NO: 1386472 - RNA, 27 nt, Human
ucuccuaugaaaggagguguuuaaggc

SEQ ID NO: 1386473 - RNA, 19 nt, Human
ucugcccccaaccagaugg

SEQ ID NO: 1386474 - RNA, 23 nt, Human
ucugcugcagaagccacaaaagc

SEQ ID NO: 1386475 - RNA, 20 nt, Human
ucuuuggccgccauucagcu

SEQ ID NO: 1386476 - RNA, 22 nt, Human
ugccggcacccagaucccucca

SEQ ID NO: 1386477 - RNA, 19 nt, Human
uggaugcacagggauaacc

SEQ ID NO: 1386478 - RNA, 21 nt, Human
ugggagagaugggcuccgggc

SEQ ID NO: 1386479 - RNA, 22 nt, Human
uguaaaagaguacccuuggcug

SEQ ID NO: 1386480 - RNA, 23 nt, Human
uguacccacugggaagaacacag

SEQ ID NO: 1386481 - RNA, 21 nt, Human
uuaugcuuuaagugcuuuggg

SEQ ID NO: 1386482 - RNA, 21 nt, Human
uucagggacuaaucacccucu

SEQ ID NO: 1386483 - RNA, 19 nt, Human
uugccucacugccucuuuc

SEQ ID NO: 1386484 - RNA, 22 nt, Human
uuucaagaacuagaacauaaug

SEQ ID NO: 1386485 - RNA, 22 nt, Human
uuuccacacuccacaggggcug

SEQ ID NO: 1386486 - RNA, 23 nt, Human
accucagccuucuucccccguaa

SEQ ID NO: 1386487 - RNA, 21 nt, Human
agagaaccucaaagacucagg

SEQ ID NO: 1386488 - RNA, 28 nt, Human
auuaguggugugugugugugugugugug

SEQ ID NO: 1386489 - RNA, 24 nt, Human
caacuccacaggcugacaguucug

SEQ ID NO: 1386490 - RNA, 21 nt, Human
ccugugagaagugucauguuu

SEQ ID NO: 1386491 - RNA, 22 nt, Human
cguaaucucccuugaagacccu

SEQ ID NO: 1386492 - RNA, 19 nt, Human
cuagaacauuugcuugacu

SEQ ID NO: 1386493 - RNA, 18 nt, Human
cucagggugauauaagaa

SEQ ID NO: 1386494 - RNA, 18 nt, Human
cugcugcugcugcugcug

SEQ ID NO: 1386495 - RNA, 19 nt, Human
cugcugcugcugcugcugc

SEQ ID NO: 1386496 - RNA, 20 nt, Human
gcccugcucucuaccucagc

SEQ ID NO: 1386497 - RNA, 19 nt, Human
gcugacaguucugcaaggc

SEQ ID NO: 1386498 - RNA, 18 nt, Human
ggaaacaacuccacaggc

SEQ ID NO: 1386499 - RNA, 23 nt, Human
ggaacucuucugaauucccauau

SEQ ID NO: 1386500 - RNA, 19 nt, Human
gugcugcugcugcugcugc

SEQ ID NO: 1386501 - RNA, 20 nt, Human
gugcugcugcugcugcugcu

SEQ ID NO: 1386502 - RNA, 21 nt, Human
guguguguguguguguacaug

SEQ ID NO: 1386503 - RNA, 20 nt, Human
gugugugugugugugugugu

SEQ ID NO: 1386504 - RNA, 20 nt, Human
uaacaggaauagagaaccuc

SEQ ID NO: 1386505 - RNA, 23 nt, Human
uaacaggaauagagaaccucaaa

SEQ ID NO: 1386506 - RNA, 23 nt, Human
uaagaaggaauugaauucccuug

SEQ ID NO: 1386507 - RNA, 22 nt, Human
uagagaaccucaaagacucagg

SEQ ID NO: 1386508 - RNA, 22 nt, Human
uaggcuccacucucagggugau

SEQ ID NO: 1386509 - RNA, 21 nt, Human
uauaagaaggaauugaauucc

SEQ ID NO: 1386510 - RNA, 24 nt, Human
ucccccguaaucucccuugaagac

SEQ ID NO: 1386511 - RNA, 22 nt, Human
ucccuugaagacccugaagggc

SEQ ID NO: 1386512 - RNA, 21 nt, Human
ucccuugcuguccauucugua

SEQ ID NO: 1386513 - RNA, 19 nt, Human
ugaagacccugaagggcua

SEQ ID NO: 1386514 - RNA, 21 nt, Human
ugacaggaagaggacaaucuc

SEQ ID NO: 1386515 - RNA, 21 nt, Human
ugcugcugcugcugcugcugc

SEQ ID NO: 1386516 - RNA, 21 nt, Human
ugcugcugcugcugcugcugc

SEQ ID NO: 1386517 - RNA, 21 nt, Human
ugcugcugcugcugcugcugc

SEQ ID NO: 1386518 - RNA, 24 nt, Human
ugcugcugcugcugcuguuacuuu

SEQ ID NO: 1386519 - RNA, 22 nt, Human
uggugugugugugugugugugu

SEQ ID NO: 1386520 - RNA, 19 nt, Human
ugugacaggaagaggacaa

SEQ ID NO: 1386521 - RNA, 19 nt, Human
uguguguguguacaugugc

SEQ ID NO: 1386522 - RNA, 19 nt, Human
uguguguguguguguacau

SEQ ID NO: 1386523 - RNA, 21 nt, Human
uguguguguguguguacaugu

SEQ ID NO: 1386524 - RNA, 18 nt, Human
ugugugugugugugugug

SEQ ID NO: 1386525 - RNA, 18 nt, Human
ugugugugugugugugug

SEQ ID NO: 1386526 - RNA, 18 nt, Human
ugugugugugugugugug

SEQ ID NO: 1386527 - RNA, 18 nt, Human
ugugugugugugugugug

SEQ ID NO: 1386528 - RNA, 18 nt, Human
ugugugugugugugugug

SEQ ID NO: 1386529 - RNA, 18 nt, Human
ugugugugugugugugug

SEQ ID NO: 1386530 - RNA, 23 nt, Human
uguguguguguguguguguacau

SEQ ID NO: 1386531 - RNA, 21 nt, Human
ugugugugugugugugugugu

SEQ ID NO: 1386532 - RNA, 21 nt, Human
ugugugugugugugugugugu

SEQ ID NO: 1386533 - RNA, 21 nt, Human
ugugugugugugugugugugu

SEQ ID NO: 1386534 - RNA, 21 nt, Human
ugugugugugugugugugugu

SEQ ID NO: 1386535 - RNA, 21 nt, Human
ugugugugugugugugugugu

SEQ ID NO: 1386536 - RNA, 21 nt, Human
ugugugugugugugugugugu

SEQ ID NO: 1386537 - RNA, 21 nt, Human
ugugugugugugugugugugu

SEQ ID NO: 1386538 - RNA, 21 nt, Human
ugugugugugugugugugugu

SEQ ID NO: 1386539 - RNA, 21 nt, Human
ugugugugugugugugugugu

SEQ ID NO: 1386540 - RNA, 22 nt, Human
ugugugugugugugugugugua

SEQ ID NO: 1386541 - RNA, 22 nt, Human
ugugugugugugugugugugug

SEQ ID NO: 1386542 - RNA, 22 nt, Human
ugugugugugugugugugugug

SEQ ID NO: 1386543 - RNA, 22 nt, Human
ugugugugugugugugugugug

SEQ ID NO: 1386544 - RNA, 22 nt, Human
ugugugugugugugugugugug

SEQ ID NO: 1386545 - RNA, 24 nt, Human
uucaagugcugcugcugcugcugc

SEQ ID NO: 1386546 - RNA, 18 nt, Human
uucccccguaaucucccu

SEQ ID NO: 1386547 - RNA, 18 nt, Human
uuuacaauauuacauuuc

SEQ ID NO: 1386548 - RNA, 19 nt, Human
aaaaaugucaaauacagaa

SEQ ID NO: 1386549 - RNA, 20 nt, Human
aaaagaggccgggcguggug

SEQ ID NO: 1386550 - RNA, 24 nt, Human
aaagaggccgggcgugguggcuca

SEQ ID NO: 1386551 - RNA, 19 nt, Human
aaagguggggggugguuca

SEQ ID NO: 1386552 - RNA, 18 nt, Human
aacauugagcaacagaga

SEQ ID NO: 1386553 - RNA, 20 nt, Human
aaccaagaaaagugcaacag

SEQ ID NO: 1386554 - RNA, 22 nt, Human
aagaggccaaaagguggggggu

SEQ ID NO: 1386555 - RNA, 23 nt, Human
aagaggccaaaagguggggggug

SEQ ID NO: 1386556 - RNA, 18 nt, Human
aaggugacaaaguagagg

SEQ ID NO: 1386557 - RNA, 22 nt, Human
aaguagggguugucaaaaaugu

SEQ ID NO: 1386558 - RNA, 25 nt, Human
aaugauaggggaagguggaggagag

SEQ ID NO: 1386559 - RNA, 23 nt, Human
acaggaagggacuguuaaccaga

SEQ ID NO: 1386560 - RNA, 19 nt, Human
acaguggugacacgaaagu

SEQ ID NO: 1386561 - RNA, 18 nt, Human
accaaaguaagggacaca

SEQ ID NO: 1386562 - RNA, 25 nt, Human
accaagaaaagugcaacaggcagau

SEQ ID NO: 1386563 - RNA, 25 nt, Human
agaaaaaaagucaaguacuagcuug

SEQ ID NO: 1386564 - RNA, 25 nt, Human
agagaaaaaaaaaauggaggucuga

SEQ ID NO: 1386565 - RNA, 26 nt, Human
agagaaaaaaaaaauggaggucugag

SEQ ID NO: 1386566 - RNA, 21 nt, Human
agagagaaaaaaaaaauggag

SEQ ID NO: 1386567 - RNA, 24 nt, Human
agaggccgggcgugguggcucacg

SEQ ID NO: 1386568 - RNA, 23 nt, Human
agauaaaaucaguaaaacuuaga

SEQ ID NO: 1386569 - RNA, 24 nt, Human
agcacuuugggaggucgagguggg

SEQ ID NO: 1386570 - RNA, 20 nt, Human
aggaauaaaugaagaggccc

SEQ ID NO: 1386571 - RNA, 28 nt, Human
auagcaaugaagaugaaagagugaugua

SEQ ID NO: 1386572 - RNA, 25 nt, Human
caaagaguacagcauuuaccaaggc

SEQ ID NO: 1386573 - RNA, 21 nt, Human
caaccaagaaaagugcaacag

SEQ ID NO: 1386574 - RNA, 24 nt, Human
cacgccuguaaucccagcacuuug

SEQ ID NO: 1386575 - RNA, 21 nt, Human
cagcacuuugggaggucgagg

SEQ ID NO: 1386576 - RNA, 24 nt, Human
cagcacuuugggaggucgaggugg

SEQ ID NO: 1386577 - RNA, 23 nt, Human
cagcuaaaaaaaaaagaggccgg

SEQ ID NO: 1386578 - RNA, 19 nt, Human
ccaaaguaagggacacagg

SEQ ID NO: 1386579 - RNA, 21 nt, Human
ccuggccaaauguggcuucug

SEQ ID NO: 1386580 - RNA, 23 nt, Human
cgccuguaaucccagcacuuugg

SEQ ID NO: 1386581 - RNA, 24 nt, Human
cgccuguaaucccagcacuuuggg

SEQ ID NO: 1386582 - RNA, 22 nt, Human
cucacgccuguaaucccagcac

SEQ ID NO: 1386583 - RNA, 24 nt, Human
cucacgccuguaaucccagcacuu

SEQ ID NO: 1386584 - RNA, 23 nt, Human
cugaaaguuccugaagucacuga

SEQ ID NO: 1386585 - RNA, 22 nt, Human
ggaauaaaugaagaggccaaaa

SEQ ID NO: 1386586 - RNA, 18 nt, Human
ggacucuacugacccuug

SEQ ID NO: 1386587 - RNA, 19 nt, Human
ggcagcuaaaaaaaaaaga

SEQ ID NO: 1386588 - RNA, 21 nt, Human
ggcucacgccuguaaucccag

SEQ ID NO: 1386589 - RNA, 19 nt, Human
gggaagguggaggagagga

SEQ ID NO: 1386590 - RNA, 24 nt, Human
gggcgugguggcucacgccuguaa

SEQ ID NO: 1386591 - RNA, 19 nt, Human
gggggugguucaggaguga

SEQ ID NO: 1386592 - RNA, 20 nt, Human
gguggaggagaggaaugagc

SEQ ID NO: 1386593 - RNA, 24 nt, Human
gguggcucacgccuguaaucccag

SEQ ID NO: 1386594 - RNA, 21 nt, Human
guaagaauauuccuucaaaag

SEQ ID NO: 1386595 - RNA, 25 nt, Human
guggagcaaaggagguuucacagag

SEQ ID NO: 1386596 - RNA, 18 nt, Human
uaaaugaagaggccaaaa

SEQ ID NO: 1386597 - RNA, 19 nt, Human
uaaaugauaggggaaggug

SEQ ID NO: 1386598 - RNA, 22 nt, Human
uaacauugagcaacagagagga

SEQ ID NO: 1386599 - RNA, 23 nt, Human
uaaggaauaaaugaagaggccaa

SEQ ID NO: 1386600 - RNA, 20 nt, Human
uaagugacauacaauagagg

SEQ ID NO: 1386601 - RNA, 21 nt, Human
uacagcauuuaccaaggcggg

SEQ ID NO: 1386602 - RNA, 21 nt, Human
uagcauacuugaugcaaagag

SEQ ID NO: 1386603 - RNA, 18 nt, Human
uaugccaaaaacuaugcu

SEQ ID NO: 1386604 - RNA, 24 nt, Human
ucaaaaagauuggcagcuaaaaaa

SEQ ID NO: 1386605 - RNA, 25 nt, Human
ucaaaaaugucaaauacagaaaaaa

SEQ ID NO: 1386606 - RNA, 20 nt, Human
uccaagaggauugacuuaau

SEQ ID NO: 1386607 - RNA, 25 nt, Human
ucugaagaaguguaagucuguuuca

SEQ ID NO: 1386608 - RNA, 19 nt, Human
ugaaagagugauguaucag

SEQ ID NO: 1386609 - RNA, 18 nt, Human
ugaagaaguguaagucug

SEQ ID NO: 1386610 - RNA, 24 nt, Human
ugaagaggccaaaagguggggggu

SEQ ID NO: 1386611 - RNA, 21 nt, Human
ugaagggagugaaaguauuug

SEQ ID NO: 1386612 - RNA, 21 nt, Human
ugaauuaaaauuacccaagcg

SEQ ID NO: 1386613 - RNA, 24 nt, Human
ugacacgaaaguggaaguuagaug

SEQ ID NO: 1386614 - RNA, 18 nt, Human
ugagccuagaaaacuuag

SEQ ID NO: 1386615 - RNA, 21 nt, Human
ugauuaagagagaaaaaaaaa

SEQ ID NO: 1386616 - RNA, 22 nt, Human
uggcucacgccuguaaucccag

SEQ ID NO: 1386617 - RNA, 24 nt, Human
uggcucacgccuguaaucccagca

SEQ ID NO: 1386618 - RNA, 20 nt, Human
ugggacaaccaagaaaaggg

SEQ ID NO: 1386619 - RNA, 19 nt, Human
ugggaggucgaggugggug

SEQ ID NO: 1386620 - RNA, 18 nt, Human
uggggggugguucaggag

SEQ ID NO: 1386621 - RNA, 24 nt, Human
uggggggugguucaggagugagca

SEQ ID NO: 1386622 - RNA, 21 nt, Human
ugguaacauugagcaacagag

SEQ ID NO: 1386623 - RNA, 24 nt, Human
ugguggcucacgccuguaauccca

SEQ ID NO: 1386624 - RNA, 24 nt, Human
uuaauaauagcaaugaagaugaaa

SEQ ID NO: 1386625 - RNA, 27 nt, Human
uuacaggaagggacuguuaaccggcgg

SEQ ID NO: 1386626 - RNA, 19 nt, Human
uuauuaauaauagcaauga

SEQ ID NO: 1386627 - RNA, 19 nt, Human
uucaccagaacauucggug

SEQ ID NO: 1386628 - RNA, 21 nt, Human
uucaccagaacauucggugga

SEQ ID NO: 1386629 - RNA, 21 nt, Human
uucauagucuuuugagucucc

SEQ ID NO: 1386630 - RNA, 18 nt, Human
uuccugcccuuaaggagc

SEQ ID NO: 1386631 - RNA, 22 nt, Human
uucuaaaauuaaccaaaguaag

SEQ ID NO: 1386632 - RNA, 23 nt, Human
uuuaaaaucaauuuauucaacaa

SEQ ID NO: 1386633 - RNA, 26 nt, Human
aaaaacagagacagaguaagaaagga

SEQ ID NO: 1386634 - RNA, 23 nt, Human
aacagccaccugggugacccccc

SEQ ID NO: 1386635 - RNA, 27 nt, Human
aaccugucuccuacaaggaccauccug

SEQ ID NO: 1386636 - RNA, 19 nt, Human
aagaagaggcucccccagg

SEQ ID NO: 1386637 - RNA, 19 nt, Human
aagcaggaacagccaccug

SEQ ID NO: 1386638 - RNA, 18 nt, Human
aagccgcagccgggcucg

SEQ ID NO: 1386639 - RNA, 19 nt, Human
aagcuccagguucuccugc

SEQ ID NO: 1386640 - RNA, 22 nt, Human
acaaacccaacacccgcagggc

SEQ ID NO: 1386641 - RNA, 18 nt, Human
acaaggaccauccugugu

SEQ ID NO: 1386642 - RNA, 21 nt, Human
accauccugugugggacccug

SEQ ID NO: 1386643 - RNA, 24 nt, Human
agccccucagccccucagccuccu

SEQ ID NO: 1386644 - RNA, 19 nt, Human
agccuccgaaagccgcagc

SEQ ID NO: 1386645 - RNA, 20 nt, Human
aggagaaaacgcguaauaaa

SEQ ID NO: 1386646 - RNA, 26 nt, Human
aggagaaaacgcguaauaaaacaaaa

SEQ ID NO: 1386647 - RNA, 21 nt, Human
agggcagcuugugcccaagag

SEQ ID NO: 1386648 - RNA, 24 nt, Human
agugagaaaacagcccagacagaa

SEQ ID NO: 1386649 - RNA, 24 nt, Human
agugagaaaacagcccagacagaa

SEQ ID NO: 1386650 - RNA, 19 nt, Human
auaaaacaaaaugcugcaa

SEQ ID NO: 1386651 - RNA, 21 nt, Human
auccugugugggacccugcca

SEQ ID NO: 1386652 - RNA, 22 nt, Human
caaaaucuaggagaaaacgcgg

SEQ ID NO: 1386653 - RNA, 19 nt, Human
caaaaugcugcaaaacaca

SEQ ID NO: 1386654 - RNA, 24 nt, Human
caaacccaacacccgcagggcuga

SEQ ID NO: 1386655 - RNA, 23 nt, Human
caaagggcagcuugugcccaaga

SEQ ID NO: 1386656 - RNA, 21 nt, Human
caagagaucauggcccagagc

SEQ ID NO: 1386657 - RNA, 18 nt, Human
caccucagcaacuuguca

SEQ ID NO: 1386658 - RNA, 21 nt, Human
caccugagcccgaaauugucc

SEQ ID NO: 1386659 - RNA, 23 nt, Human
caccugggugaccccccucccua

SEQ ID NO: 1386660 - RNA, 20 nt, Human
cacgugacgugcgguggacc

SEQ ID NO: 1386661 - RNA, 20 nt, Human
cagcaaagggcagcuugugc

SEQ ID NO: 1386662 - RNA, 19 nt, Human
cagcccagacagaaagcag

SEQ ID NO: 1386663 - RNA, 25 nt, Human
cagccccucagccccucagccuccu

SEQ ID NO: 1386664 - RNA, 19 nt, Human
cagccccucagccgccuca

SEQ ID NO: 1386665 - RNA, 20 nt, Human
caggaacagccaccugggug

SEQ ID NO: 1386666 - RNA, 22 nt, Human
caggagcccacggccucagaaa

SEQ ID NO: 1386667 - RNA, 19 nt, Human
caggcaaaggggaaauugg

SEQ ID NO: 1386668 - RNA, 25 nt, Human
cagugccaagagaucauggcccaga

SEQ ID NO: 1386669 - RNA, 19 nt, Human
caucaggcaccucagcaac

SEQ ID NO: 1386670 - RNA, 19 nt, Human
caugauccgugcccaacgc

SEQ ID NO: 1386671 - RNA, 19 nt, Human
cauggcccagagcuggcag

SEQ ID NO: 1386672 - RNA, 22 nt, Human
ccaacaaacccaacacccgcag

SEQ ID NO: 1386673 - RNA, 19 nt, Human
ccaagagaucauggcccag

SEQ ID NO: 1386674 - RNA, 22 nt, Human
ccaagagaucauggcccagagc

SEQ ID NO: 1386675 - RNA, 22 nt, Human
ccaccugggugaccccccuccc

SEQ ID NO: 1386676 - RNA, 22 nt, Human
ccagccaaggccucccggagcc

SEQ ID NO: 1386677 - RNA, 22 nt, Human
ccaggaguccugggcaggggca

SEQ ID NO: 1386678 - RNA, 22 nt, Human
ccccaacaaacccaacacccgc

SEQ ID NO: 1386679 - RNA, 19 nt, Human
cccccaggaugcaaacuca

SEQ ID NO: 1386680 - RNA, 21 nt, Human
cccucagccgccucaggcccu

SEQ ID NO: 1386681 - RNA, 29 nt, Human
cccugcaccugagcccgaaauuguccccc

SEQ ID NO: 1386682 - RNA, 23 nt, Human
ccucagcaacuugucaaaccugu

SEQ ID NO: 1386683 - RNA, 18 nt, Human
cgcccaggacgcgcccgc

SEQ ID NO: 1386684 - RNA, 18 nt, Human
cgcccccugcaccugagc

SEQ ID NO: 1386685 - RNA, 24 nt, Human
cgccugccacugacuccuggccgc

SEQ ID NO: 1386686 - RNA, 19 nt, Human
cggcagggaccggccaggc

SEQ ID NO: 1386687 - RNA, 21 nt, Human
cgggcuccagggcagccuccu

SEQ ID NO: 1386688 - RNA, 24 nt, Human
cggugucuuccaaacccaagccuc

SEQ ID NO: 1386689 - RNA, 24 nt, Human
cguaauaaaacaaaaugcugcaaa

SEQ ID NO: 1386690 - RNA, 22 nt, Human
cucagccccucagccgccucag

SEQ ID NO: 1386691 - RNA, 22 nt, Human
cucagccccucagccuccucag

SEQ ID NO: 1386692 - RNA, 20 nt, Human
cuccagguucuccugccagg

SEQ ID NO: 1386693 - RNA, 21 nt, Human
cucccggagccaucacccacc

SEQ ID NO: 1386694 - RNA, 20 nt, Human
cuccucagccccucagcccc

SEQ ID NO: 1386695 - RNA, 21 nt, Human
gaaauuguccccaacaaaccc

SEQ ID NO: 1386696 - RNA, 22 nt, Human
gcaaagggcagcuugugcccaa

SEQ ID NO: 1386697 - RNA, 24 nt, Human
gcagucagcucagcagcucucccu

SEQ ID NO: 1386698 - RNA, 23 nt, Human
gcccgcgcuggggaagcgccccc

SEQ ID NO: 1386699 - RNA, 24 nt, Human
gccgcgccugccacugacuccugg

SEQ ID NO: 1386700 - RNA, 20 nt, Human
ggaauggucuggaaaguggg

SEQ ID NO: 1386701 - RNA, 21 nt, Human
gggcagggccaguccggggga

SEQ ID NO: 1386702 - RNA, 23 nt, Human
gggcagggccaguccgggggagc

SEQ ID NO: 1386703 - RNA, 19 nt, Human
guccccaacaaacccaaca

SEQ ID NO: 1386704 - RNA, 21 nt, Human
uaaaacaaaaugcugcaaaac

SEQ ID NO: 1386705 - RNA, 18 nt, Human
uaagaaaggacaccgagc

SEQ ID NO: 1386706 - RNA, 26 nt, Human
ucagcaacuugucaaaccugucuccu

SEQ ID NO: 1386707 - RNA, 18 nt, Human
ucagccccucagccccuc

SEQ ID NO: 1386708 - RNA, 18 nt, Human
ucagccccucagccccuc

SEQ ID NO: 1386709 - RNA, 21 nt, Human
ucagccccucagccgccucag

SEQ ID NO: 1386710 - RNA, 21 nt, Human
ucagccccucagccuccucag

SEQ ID NO: 1386711 - RNA, 21 nt, Human
ucagccccucagccuccucag

SEQ ID NO: 1386712 - RNA, 21 nt, Human
ucagccgccucaggcccucag

SEQ ID NO: 1386713 - RNA, 19 nt, Human
ucagccuccucagccccuc

SEQ ID NO: 1386714 - RNA, 19 nt, Human
ucagccuccucagccccuc

SEQ ID NO: 1386715 - RNA, 21 nt, Human
ucagccuccucagccccucag

SEQ ID NO: 1386716 - RNA, 21 nt, Human
ucagccuccucagccccucag

SEQ ID NO: 1386717 - RNA, 18 nt, Human
ucagccuuucagccccuc

SEQ ID NO: 1386718 - RNA, 18 nt, Human
ucagcucagcagcucucc

SEQ ID NO: 1386719 - RNA, 21 nt, Human
ucaggcaaaggggaaauugga

SEQ ID NO: 1386720 - RNA, 19 nt, Human
ucaggcccucagccuuuca

SEQ ID NO: 1386721 - RNA, 23 nt, Human
uccaaacccaagccuccgaaagc

SEQ ID NO: 1386722 - RNA, 22 nt, Human
uccacgcugucgcgggcuucug

SEQ ID NO: 1386723 - RNA, 23 nt, Human
ucccagccaaggccucccggagc

SEQ ID NO: 1386724 - RNA, 21 nt, Human
uccccaacaaacccaacaccc

SEQ ID NO: 1386725 - RNA, 23 nt, Human
uccgugcccaacgccagcaaagg

SEQ ID NO: 1386726 - RNA, 24 nt, Human
ugaaaugggcaccgcgugcuuucc

SEQ ID NO: 1386727 - RNA, 19 nt, Human
ugccuggaauggucuggaa

SEQ ID NO: 1386728 - RNA, 23 nt, Human
ugcggugucgaugaaaugggcac

SEQ ID NO: 1386729 - RNA, 24 nt, Human
uggaauggucuggaaagugggggc

SEQ ID NO: 1386730 - RNA, 21 nt, Human
ugggacccugccaagcuccua

SEQ ID NO: 1386731 - RNA, 19 nt, Human
ugggcaggggcaccaccug

SEQ ID NO: 1386732 - RNA, 18 nt, Human
ugggugaccccccucccu

SEQ ID NO: 1386733 - RNA, 20 nt, Human
ugucccagccaaggccuccc

SEQ ID NO: 1386734 - RNA, 21 nt, Human
uguccccaacaaacccaacac

SEQ ID NO: 1386735 - RNA, 21 nt, Human
uucccgggaaucugaaagcuc

SEQ ID NO: 1386736 - RNA, 24 nt, Human
uuggauccuugccagguuuccagu

SEQ ID NO: 1386737 - RNA, 18 nt, Human
aaaaacauucuggucauc

SEQ ID NO: 1386738 - RNA, 24 nt, Human
aaaagccuuuuuauuuccuucacc

SEQ ID NO: 1386739 - RNA, 21 nt, Human
aaacauuuaagauugccuacu

SEQ ID NO: 1386740 - RNA, 20 nt, Human
aaaggaacauggugguugcg

SEQ ID NO: 1386741 - RNA, 24 nt, Human
aaccauaagcagucuucugauuca

SEQ ID NO: 1386742 - RNA, 19 nt, Human
aaccauugaaagauaauag

SEQ ID NO: 1386743 - RNA, 18 nt, Human
aagcuaccagcuucuccc

SEQ ID NO: 1386744 - RNA, 19 nt, Human
aagcuuacauuuaugcugc

SEQ ID NO: 1386745 - RNA, 21 nt, Human
aaugaaugacuaaauaugccc

SEQ ID NO: 1386746 - RNA, 23 nt, Human
acaagaaaggcacuagaaacaua

SEQ ID NO: 1386747 - RNA, 24 nt, Human
acacccucugcuguguuccaacuu

SEQ ID NO: 1386748 - RNA, 21 nt, Human
acuggagucacggcagccgcc

SEQ ID NO: 1386749 - RNA, 19 nt, Human
agcacuucggacaauuugu

SEQ ID NO: 1386750 - RNA, 22 nt, Human
agcaggcaguccccagcucucu

SEQ ID NO: 1386751 - RNA, 25 nt, Human
aggcucugacucuaauuaacaaccu

SEQ ID NO: 1386752 - RNA, 18 nt, Human
aguacaguuccaucaccu

SEQ ID NO: 1386753 - RNA, 20 nt, Human
auagaauacuuccccaaaca

SEQ ID NO: 1386754 - RNA, 21 nt, Human
auagaauacuuccccaaacau

SEQ ID NO: 1386755 - RNA, 24 nt, Human
augagcagagacuuguuuggcaag

SEQ ID NO: 1386756 - RNA, 18 nt, Human
caaaccccauucagguac

SEQ ID NO: 1386757 - RNA, 19 nt, Human
caaaguuaccaaaccuuuc

SEQ ID NO: 1386758 - RNA, 22 nt, Human
caaccagacacuuucgggcauc

SEQ ID NO: 1386759 - RNA, 24 nt, Human
caaccagacacuuucgggcauccc

SEQ ID NO: 1386760 - RNA, 24 nt, Human
cacccucugcuguguuccaacuuu

SEQ ID NO: 1386761 - RNA, 21 nt, Human
caggaaauguguacagugcau

SEQ ID NO: 1386762 - RNA, 24 nt, Human
cagguccuuuggagagaaaaaaag

SEQ ID NO: 1386763 - RNA, 24 nt, Human
cauuuucaaaacucucuuuaagaa

SEQ ID NO: 1386764 - RNA, 24 nt, Human
cauuuugaaaaauaaaguuaggaa

SEQ ID NO: 1386765 - RNA, 21 nt, Human
ccaaucuguauuuuauuacac

SEQ ID NO: 1386766 - RNA, 18 nt, Human
ccaccgcgagccucccgg

SEQ ID NO: 1386767 - RNA, 21 nt, Human
cccaagaaaauaauacgcuuu

SEQ ID NO: 1386768 - RNA, 21 nt, Human
ccccaaucgcgcucuccgacc

SEQ ID NO: 1386769 - RNA, 21 nt, Human
ccccgccgcggaaugaaaucc

SEQ ID NO: 1386770 - RNA, 19 nt, Human
ccgaccggcucccuaggcg

SEQ ID NO: 1386771 - RNA, 18 nt, Human
ccgcagccgcugccccgc

SEQ ID NO: 1386772 - RNA, 19 nt, Human
ccgccgccugccgcccgca

SEQ ID NO: 1386773 - RNA, 21 nt, Human
ccgccugccgcccgcagccgc

SEQ ID NO: 1386774 - RNA, 20 nt, Human
cgacagggcaggacacuguc

SEQ ID NO: 1386775 - RNA, 24 nt, Human
cggggcuccgcaccccaaucgcgc

SEQ ID NO: 1386776 - RNA, 21 nt, Human
cucccgaccugcccgccgccu

SEQ ID NO: 1386777 - RNA, 23 nt, Human
cucccgaccugcccgccgccugc

SEQ ID NO: 1386778 - RNA, 18 nt, Human
cuccgcaccccaaucgcg

SEQ ID NO: 1386779 - RNA, 22 nt, Human
cucggcucguucauccuguggg

SEQ ID NO: 1386780 - RNA, 23 nt, Human
cucucccaagaugcauuuuuaaa

SEQ ID NO: 1386781 - RNA, 20 nt, Human
cugauuuuacaaaacccaaa

SEQ ID NO: 1386782 - RNA, 20 nt, Human
cugcccgccgccugccgccc

SEQ ID NO: 1386783 - RNA, 25 nt, Human
gaguucuuagcacuucggacaauuu

SEQ ID NO: 1386784 - RNA, 18 nt, Human
gauuucagaaucaaaccc

SEQ ID NO: 1386785 - RNA, 20 nt, Human
gcaacagguagaaagauuuc

SEQ ID NO: 1386786 - RNA, 18 nt, Human
gcccgccgccugccgccc

SEQ ID NO: 1386787 - RNA, 22 nt, Human
ggaaagaccagaacuuaugaua

SEQ ID NO: 1386788 - RNA, 19 nt, Human
ggaaauguguacagugcau

SEQ ID NO: 1386789 - RNA, 21 nt, Human
ggcuuacagcccaaucuuugg

SEQ ID NO: 1386790 - RNA, 19 nt, Human
gggagguguuuauuuuaug

SEQ ID NO: 1386791 - RNA, 22 nt, Human
gucagcccaggccgguccuucu

SEQ ID NO: 1386792 - RNA, 20 nt, Human
gugaacaggcucugacucua

SEQ ID NO: 1386793 - RNA, 21 nt, Human
uaaaagccuuuuuauuuccuu

SEQ ID NO: 1386794 - RNA, 23 nt, Human
uaagaaaagauauucauggcugu

SEQ ID NO: 1386795 - RNA, 21 nt, Human
uaauacgcuuuauuuccagau

SEQ ID NO: 1386796 - RNA, 22 nt, Human
uacaaagauuuaaaacaaacaa

SEQ ID NO: 1386797 - RNA, 23 nt, Human
uacaaagauuuaaaacaaacaaa

SEQ ID NO: 1386798 - RNA, 18 nt, Human
uacaauacaaauaucacc

SEQ ID NO: 1386799 - RNA, 21 nt, Human
uacaaucaagacaagaaaggc

SEQ ID NO: 1386800 - RNA, 20 nt, Human
uacacacccucugcuguguu

SEQ ID NO: 1386801 - RNA, 23 nt, Human
uacagcccaaucuuuggggcaag

SEQ ID NO: 1386802 - RNA, 24 nt, Human
uaccaaaucgacgauaaaauaauu

SEQ ID NO: 1386803 - RNA, 18 nt, Human
uaccaguauacucucugg

SEQ ID NO: 1386804 - RNA, 19 nt, Human
uagacaaauuucucuccca

SEQ ID NO: 1386805 - RNA, 19 nt, Human
uaggaaauacuuagaaaau

SEQ ID NO: 1386806 - RNA, 19 nt, Human
uagguuaaauuuuucuuua

SEQ ID NO: 1386807 - RNA, 20 nt, Human
uauagaauagaauacuuccc

SEQ ID NO: 1386808 - RNA, 21 nt, Human
uaucaacagguuccuuuaaaa

SEQ ID NO: 1386809 - RNA, 20 nt, Human
uaugaacaggaaauguguac

SEQ ID NO: 1386810 - RNA, 23 nt, Human
uauguuaggaguaaaacuuagag

SEQ ID NO: 1386811 - RNA, 27 nt, Human
ucacucccgaccugcccgccgccugcc

SEQ ID NO: 1386812 - RNA, 23 nt, Human
ucauugaguaguuaaaauugaac

SEQ ID NO: 1386813 - RNA, 23 nt, Human
uccaacuuuacuguucuugaaau

SEQ ID NO: 1386814 - RNA, 23 nt, Human
ucccaaacuuaugaacaggaaau

SEQ ID NO: 1386815 - RNA, 22 nt, Human
ucccgggcugccgagcaugccc

SEQ ID NO: 1386816 - RNA, 21 nt, Human
ucuuuuuuuuugcacuuuuug

SEQ ID NO: 1386817 - RNA, 23 nt, Human
ugaacaggaaauguguacagugc

SEQ ID NO: 1386818 - RNA, 22 nt, Human
ugacucuaauuaacaaccucau

SEQ ID NO: 1386819 - RNA, 20 nt, Human
ugaggcagguucucgucuuc

SEQ ID NO: 1386820 - RNA, 19 nt, Human
ugcacuuuuugaaacacug

SEQ ID NO: 1386821 - RNA, 23 nt, Human
uggcaggucagcagucacuguuc

SEQ ID NO: 1386822 - RNA, 18 nt, Human
uggcuuacagcccaaucu

SEQ ID NO: 1386823 - RNA, 18 nt, Human
uggcuuacagcccaaucu

SEQ ID NO: 1386824 - RNA, 19 nt, Human
uguauacauauauuuauau

SEQ ID NO: 1386825 - RNA, 21 nt, Human
ugugccugaaucaugcuguua

SEQ ID NO: 1386826 - RNA, 21 nt, Human
uucaaaaaguccacacuccuu

SEQ ID NO: 1386827 - RNA, 22 nt, Human
uucaccaacaaaauugucauga

SEQ ID NO: 1386828 - RNA, 18 nt, Human
uugcugaggcagguucuc

SEQ ID NO: 1386829 - RNA, 22 nt, Human
uuuacaaaacccaaaguuacca

SEQ ID NO: 1386830 - RNA, 23 nt, Human
uuucugugucuaucauuuuuauu

SEQ ID NO: 1386831 - RNA, 21 nt, Human
aaaaaaaaagaaggagaagaa

SEQ ID NO: 1386832 - RNA, 22 nt, Human
aaaaaaucuccacccaucccac

SEQ ID NO: 1386833 - RNA, 24 nt, Human
aaaaagaaggagaagaauaaaaga

SEQ ID NO: 1386834 - RNA, 19 nt, Human
aaagaaaaagaaaaaaccc

SEQ ID NO: 1386835 - RNA, 21 nt, Human
aaaggaacaaacgccagagcg

SEQ ID NO: 1386836 - RNA, 23 nt, Human
aaauauacacuaucaugaacacg

SEQ ID NO: 1386837 - RNA, 19 nt, Human
aagaaagaaaaagaaaaaa

SEQ ID NO: 1386838 - RNA, 23 nt, Human
aagaaagaaaaagaaaaaaccca

SEQ ID NO: 1386839 - RNA, 22 nt, Human
aagaaggagaagaauaaaagaa

SEQ ID NO: 1386840 - RNA, 18 nt, Human
aaucuccacccaucccac

SEQ ID NO: 1386841 - RNA, 21 nt, Human
aaucuccacccaucccaccuc

SEQ ID NO: 1386842 - RNA, 26 nt, Human
acacuuaacacaagacaugcaauaac

SEQ ID NO: 1386843 - RNA, 21 nt, Human
acuguauuccaguucuaggca

SEQ ID NO: 1386844 - RNA, 19 nt, Human
agaaaaagaaaaaacccau

SEQ ID NO: 1386845 - RNA, 18 nt, Human
agaagaauaaaagaaaga

SEQ ID NO: 1386846 - RNA, 21 nt, Human
agaaggagaagaauaaaagaa

SEQ ID NO: 1386847 - RNA, 18 nt, Human
agcucagccucacccgca

SEQ ID NO: 1386848 - RNA, 24 nt, Human
aggcacuggccgacaacgcuccgc

SEQ ID NO: 1386849 - RNA, 19 nt, Human
auguuuugaguuuuguacc

SEQ ID NO: 1386850 - RNA, 21 nt, Human
caaaggaacaaacgccagagc

SEQ ID NO: 1386851 - RNA, 23 nt, Human
caacuucacggaaggcacuggcc

SEQ ID NO: 1386852 - RNA, 19 nt, Human
caauaucauauacaaaaca

SEQ ID NO: 1386853 - RNA, 19 nt, Human
cacuggccgacaacgcucc

SEQ ID NO: 1386854 - RNA, 25 nt, Human
caggccgcaaggcgaggggcgggga

SEQ ID NO: 1386855 - RNA, 22 nt, Human
caugcaauaacaaagcuaaauc

SEQ ID NO: 1386856 - RNA, 23 nt, Human
caugcaauaacaaagcuaaauca

SEQ ID NO: 1386857 - RNA, 20 nt, Human
cauucauuacaugacugcuc

SEQ ID NO: 1386858 - RNA, 21 nt, Human
cccaacgacccggcgagcaac

SEQ ID NO: 1386859 - RNA, 21 nt, Human
ccgccuacaggucgacagggg

SEQ ID NO: 1386860 - RNA, 23 nt, Human
ccgcgccacuccggccuugcgcc

SEQ ID NO: 1386861 - RNA, 22 nt, Human
ccuaaagugcaucuuuugaaga

SEQ ID NO: 1386862 - RNA, 24 nt, Human
ccuacacacuugaggccaccgagu

SEQ ID NO: 1386863 - RNA, 26 nt, Human
ccuccaagaccaauccgggcucccca

SEQ ID NO: 1386864 - RNA, 19 nt, Human
ccugaaucuggaggacagc

SEQ ID NO: 1386865 - RNA, 22 nt, Human
ccugcgcagccguugcuccucc

SEQ ID NO: 1386866 - RNA, 24 nt, Human
ccuugcgccauuccggccccacga

SEQ ID NO: 1386867 - RNA, 23 nt, Human
cgagcaacuucacggaaggcacu

SEQ ID NO: 1386868 - RNA, 19 nt, Human
cgcagcccgggcgcccccc

SEQ ID NO: 1386869 - RNA, 23 nt, Human
cgcccaaaggaacaaacgccaga

SEQ ID NO: 1386870 - RNA, 18 nt, Human
cgcccccccugccggccg

SEQ ID NO: 1386871 - RNA, 22 nt, Human
cgcccccccugccggccgcucg

SEQ ID NO: 1386872 - RNA, 18 nt, Human
cggccggcggcggcagcg

SEQ ID NO: 1386873 - RNA, 18 nt, Human
cgggcgcccccccugccg

SEQ ID NO: 1386874 - RNA, 23 nt, Human
cuacaggucgacagggcccaacg

SEQ ID NO: 1386875 - RNA, 24 nt, Human
cuccacccaucccaccucugaaaa

SEQ ID NO: 1386876 - RNA, 22 nt, Human
cuccccagacccaccggccuga

SEQ ID NO: 1386877 - RNA, 18 nt, Human
cucgcagcccgggcgccc

SEQ ID NO: 1386878 - RNA, 20 nt, Human
cucugaaaaaaaaagaagga

SEQ ID NO: 1386879 - RNA, 26 nt, Human
cucugaaaaaaaaagaaggagaagaa

SEQ ID NO: 1386880 - RNA, 21 nt, Human
cuggaggacagcaguccgcgu

SEQ ID NO: 1386881 - RNA, 21 nt, Human
gaaaaaaaaagaaggagaaga

SEQ ID NO: 1386882 - RNA, 18 nt, Human
gaggacagcaguccgcgu

SEQ ID NO: 1386883 - RNA, 25 nt, Human
gcaaaucuuuuagagucgaacaaaa

SEQ ID NO: 1386884 - RNA, 21 nt, Human
gcagaacaguaagauguagag

SEQ ID NO: 1386885 - RNA, 19 nt, Human
gccggcggcggcagcgcgg

SEQ ID NO: 1386886 - RNA, 25 nt, Human
ggaaggcacuggccgacaacgcucc

SEQ ID NO: 1386887 - RNA, 24 nt, Human
ggcagaacaguaagauguagagga

SEQ ID NO: 1386888 - RNA, 19 nt, Human
gggcagcagcggccggcgu

SEQ ID NO: 1386889 - RNA, 25 nt, Human
gggcagcagcggccggcgucaggcc

SEQ ID NO: 1386890 - RNA, 26 nt, Human
uaaaaaggaacuugcuaauaaagcca

SEQ ID NO: 1386891 - RNA, 23 nt, Human
uaaaauauacacuaucaugaaca

SEQ ID NO: 1386892 - RNA, 19 nt, Human
uaagaaaaaccgagcugug

SEQ ID NO: 1386893 - RNA, 19 nt, Human
uacuuugacuuuucuaguu

SEQ ID NO: 1386894 - RNA, 22 nt, Human
uauacaaaacacuuaacacaaa

SEQ ID NO: 1386895 - RNA, 22 nt, Human
ucagcacccgucgggaaagccg

SEQ ID NO: 1386896 - RNA, 25 nt, Human
ucagcacccgucgggaaagccgcgu

SEQ ID NO: 1386897 - RNA, 21 nt, Human
uccgcgugacaacagcgacuc

SEQ ID NO: 1386898 - RNA, 24 nt, Human
uccgggcuccccagacccaccggc

SEQ ID NO: 1386899 - RNA, 22 nt, Human
uccuaaagugcaucuuuugaag

SEQ ID NO: 1386900 - RNA, 22 nt, Human
ucuaggcaaaccagguuugaag

SEQ ID NO: 1386901 - RNA, 25 nt, Human
ucugaaaaaaaaagaaggagaagaa

SEQ ID NO: 1386902 - RNA, 18 nt, Human
ugaaaaaaaaagaaggag

SEQ ID NO: 1386903 - RNA, 18 nt, Human
ugaguagagccauucauu

SEQ ID NO: 1386904 - RNA, 19 nt, Human
ugccuaguaaaacugcaau

SEQ ID NO: 1386905 - RNA, 19 nt, Human
uggcaagugggacaucuuc

SEQ ID NO: 1386906 - RNA, 23 nt, Human
uguaccuacacacuugaggccac

SEQ ID NO: 1386907 - RNA, 21 nt, Human
uucaaaagguaaaaaguuggc

SEQ ID NO: 1386908 - RNA, 24 nt, Human
uucuucuaaaauaugucgcaggca

SEQ ID NO: 1386909 - RNA, 27 nt, Human
uuuaaaaaaucuccacccaucccaccu

SEQ ID NO: 1386910 - RNA, 29 nt, Human
uuuaaaaaaucuccacccaucccaccucu

SEQ ID NO: 1386911 - RNA, 18 nt, Human
uuugaguuuuguaccuac

SEQ ID NO: 1386912 - RNA, 24 nt, Human
gacuacguaaccaaaaaucaaaau

SEQ ID NO: 1386913 - RNA, 26 nt, Human
aaaaauauggaaaaaaaaaccacagc

SEQ ID NO: 1386914 - RNA, 24 nt, Human
aaaacaaaaacaaaaaaaaucaca

SEQ ID NO: 1386915 - RNA, 19 nt, Human
aaaauaauuuagucugcaa

SEQ ID NO: 1386916 - RNA, 21 nt, Human
aaacaaaaacaaaaaaaauca

SEQ ID NO: 1386917 - RNA, 18 nt, Human
aaagaaggaacagauaug

SEQ ID NO: 1386918 - RNA, 26 nt, Human
aaagggcuuuuuuuuuuauuauuauu

SEQ ID NO: 1386919 - RNA, 23 nt, Human
aagaaagccuuucuggguuggcc

SEQ ID NO: 1386920 - RNA, 23 nt, Human
aagaggaggcagaugcaccuaua

SEQ ID NO: 1386921 - RNA, 22 nt, Human
aagaguugacagggaagugaaa

SEQ ID NO: 1386922 - RNA, 20 nt, Human
acaacagaaauaagagaaaa

SEQ ID NO: 1386923 - RNA, 19 nt, Human
acacauuuaaaucuucuua

SEQ ID NO: 1386924 - RNA, 21 nt, Human
accauaaaaaggcaucauaaa

SEQ ID NO: 1386925 - RNA, 27 nt, Human
accauaaaaaggcaucauaaagaagga

SEQ ID NO: 1386926 - RNA, 21 nt, Human
agaaaugaauuauuaagucua

SEQ ID NO: 1386927 - RNA, 24 nt, Human
aggcaucauaaagaaggaacagau

SEQ ID NO: 1386928 - RNA, 21 nt, Human
aggcuuuaaaaacaaaaacaa

SEQ ID NO: 1386929 - RNA, 26 nt, Human
auaaaauuaaaaaacugaaaggucag

SEQ ID NO: 1386930 - RNA, 22 nt, Human
auagaggguaaccuaccauaca

SEQ ID NO: 1386931 - RNA, 23 nt, Human
caacagaaauaagagaaaauaaa

SEQ ID NO: 1386932 - RNA, 21 nt, Human
caccauuguaagaauuaagaa

SEQ ID NO: 1386933 - RNA, 21 nt, Human
cagauaugcgcuccauagucc

SEQ ID NO: 1386934 - RNA, 23 nt, Human
ccacagaaacuucaauucccaga

SEQ ID NO: 1386935 - RNA, 24 nt, Human
cugguuacggcucacgcuuccuuc

SEQ ID NO: 1386936 - RNA, 19 nt, Human
gaaaauaaaauguucuucc

SEQ ID NO: 1386937 - RNA, 22 nt, Human
gagcugaagaguugacagggaa

SEQ ID NO: 1386938 - RNA, 22 nt, Human
gaucuuucaauagcaacagccu

SEQ ID NO: 1386939 - RNA, 18 nt, Human
ggcaauagaucauaaaga

SEQ ID NO: 1386940 - RNA, 23 nt, Human
ggccugguuacggcucacgcuuc

SEQ ID NO: 1386941 - RNA, 23 nt, Human
uacaaaguuuaaagggcuuuuuu

SEQ ID NO: 1386942 - RNA, 18 nt, Human
uacaugcauauuaucaca

SEQ ID NO: 1386943 - RNA, 29 nt, Human
uagcaacagccuuauaaaauaauuuaguu

SEQ ID NO: 1386944 - RNA, 18 nt, Human
uagucugcaaaauucaau

SEQ ID NO: 1386945 - RNA, 18 nt, Human
uaucacauguguauuuga

SEQ ID NO: 1386946 - RNA, 28 nt, Human
uauuuacaugcauauuaucacaugugua

SEQ ID NO: 1386947 - RNA, 22 nt, Human
ucagaaccauaaaaaggcaucc

SEQ ID NO: 1386948 - RNA, 21 nt, Human
uccacagaaacuucaauuccc

SEQ ID NO: 1386949 - RNA, 25 nt, Human
ucuaaagaauauaaaaugaaagaaa

SEQ ID NO: 1386950 - RNA, 30 nt, Human
ugacagggaagugaaaucucagaaagaaaa

SEQ ID NO: 1386951 - RNA, 21 nt, Human
uggccugguuacggcucacgc

SEQ ID NO: 1386952 - RNA, 23 nt, Human
uuaaaaaacugaaaggucagaag

SEQ ID NO: 1386953 - RNA, 18 nt, Human
uuaaacuaaaaggaaacc

SEQ ID NO: 1386954 - RNA, 25 nt, Human
uuacaugcauauuaucacaugugua

SEQ ID NO: 1386955 - RNA, 21 nt, Human
uuagagaagaggaggcagaug

SEQ ID NO: 1386956 - RNA, 26 nt, Human
uuuuauaauugaaguaacuuaucacc

SEQ ID NO: 1386957 - RNA, 22 nt, Human
aaacagcaccucccggaccagc

SEQ ID NO: 1386958 - RNA, 23 nt, Human
aaguucuucaauagcagcaguuu

SEQ ID NO: 1386959 - RNA, 21 nt, Human
agacaggaagguuaggucaga

SEQ ID NO: 1386960 - RNA, 19 nt, Human
agcguuggccugggggcga

SEQ ID NO: 1386961 - RNA, 25 nt, Human
agcugcagugucuucugcuguaagg

SEQ ID NO: 1386962 - RNA, 19 nt, Human
aggagacaggaagguuagg

SEQ ID NO: 1386963 - RNA, 21 nt, Human
agggggcauuaauacugcccu

SEQ ID NO: 1386964 - RNA, 21 nt, Human
agguuaggucagaaguaugcu

SEQ ID NO: 1386965 - RNA, 24 nt, Human
aguggccucccaccaugagccuca

SEQ ID NO: 1386966 - RNA, 23 nt, Human
augguaccgggcaccaugaagca

SEQ ID NO: 1386967 - RNA, 22 nt, Human
caauagcagcaguuuggggaca

SEQ ID NO: 1386968 - RNA, 19 nt, Human
cacaaccacugcucuuuuu

SEQ ID NO: 1386969 - RNA, 19 nt, Human
cagaaaagagcacaaccac

SEQ ID NO: 1386970 - RNA, 18 nt, Human
cagaaagggucagaaaca

SEQ ID NO: 1386971 - RNA, 23 nt, Human
cagaaguccuuggguucuaccag

SEQ ID NO: 1386972 - RNA, 21 nt, Human
cagauagagcuucccucccag

SEQ ID NO: 1386973 - RNA, 24 nt, Human
caggucuugggguuuggucggggg

SEQ ID NO: 1386974 - RNA, 22 nt, Human
ccaggggccaccagcccaggau

SEQ ID NO: 1386975 - RNA, 22 nt, Human
ccaggucuugggguuuggucgg

SEQ ID NO: 1386976 - RNA, 18 nt, Human
cccaaaagcccugcaugc

SEQ ID NO: 1386977 - RNA, 23 nt, Human
cccaaaagcccugcaugcugucc

SEQ ID NO: 1386978 - RNA, 19 nt, Human
ccccaaaagcccugcaugc

SEQ ID NO: 1386979 - RNA, 24 nt, Human
ccccaaaagcccugcaugcugucc

SEQ ID NO: 1386980 - RNA, 21 nt, Human
ccccaccccaacacagucaaa

SEQ ID NO: 1386981 - RNA, 24 nt, Human
ccccugaauguacaucaauuucca

SEQ ID NO: 1386982 - RNA, 22 nt, Human
ccggccucucccacauuucucc

SEQ ID NO: 1386983 - RNA, 25 nt, Human
ccguccccugaauguacaucaauuu

SEQ ID NO: 1386984 - RNA, 18 nt, Human
ccucccaguggacccugc

SEQ ID NO: 1386985 - RNA, 23 nt, Human
ccuugggacccugggggagaugu

SEQ ID NO: 1386986 - RNA, 19 nt, Human
ccuuuucgagcagcagcua

SEQ ID NO: 1386987 - RNA, 23 nt, Human
cggagccaggggccaccagccca

SEQ ID NO: 1386988 - RNA, 27 nt, Human
cuccauggcuuugcccuuaauguugcu

SEQ ID NO: 1386989 - RNA, 25 nt, Human
cucugcauuuggccucauucugcug

SEQ ID NO: 1386990 - RNA, 27 nt, Human
cucuuuuucacuauuuuacagcuauuu

SEQ ID NO: 1386991 - RNA, 25 nt, Human
cugcggggccuugggacccuggggg

SEQ ID NO: 1386992 - RNA, 20 nt, Human
cugcugcuucucaguaccca

SEQ ID NO: 1386993 - RNA, 23 nt, Human
cuuucagggggcuguugugagga

SEQ ID NO: 1386994 - RNA, 19 nt, Human
cuuuuugggauggcucugg

SEQ ID NO: 1386995 - RNA, 23 nt, Human
gaaaagagcacaaccacugcucu

SEQ ID NO: 1386996 - RNA, 23 nt, Human
gagaccacuccgacagaaagggu

SEQ ID NO: 1386997 - RNA, 22 nt, Human
gagcagcagcuaggaaggugag

SEQ ID NO: 1386998 - RNA, 21 nt, Human
gauggaggagcggggggaagc

SEQ ID NO: 1386999 - RNA, 20 nt, Human
gauuucauuccuuucucagu

SEQ ID NO: 1387000 - RNA, 26 nt, Human
gcaaacuuuccuuuagggcuuuguaa

SEQ ID NO: 1387001 - RNA, 20 nt, Human
gccccaaaagcccugcaugc

SEQ ID NO: 1387002 - RNA, 20 nt, Human
ggacaucacguguagcccug

SEQ ID NO: 1387003 - RNA, 20 nt, Human
ggacaucacguguagcccug

SEQ ID NO: 1387004 - RNA, 21 nt, Human
ggacaucacguguagcccugu

SEQ ID NO: 1387005 - RNA, 18 nt, Human
ggagacaggaagguuagg

SEQ ID NO: 1387006 - RNA, 21 nt, Human
gggggaggaagcugcggggcc

SEQ ID NO: 1387007 - RNA, 21 nt, Human
ggucgggggaggaagcugcgg

SEQ ID NO: 1387008 - RNA, 22 nt, Human
gucuggacucuggaguacagga

SEQ ID NO: 1387009 - RNA, 24 nt, Human
guggagacuguugucuccugggau

SEQ ID NO: 1387010 - RNA, 20 nt, Human
uacccaacccccaccccaac

SEQ ID NO: 1387011 - RNA, 20 nt, Human
uagcugcaucccaugucagu

SEQ ID NO: 1387012 - RNA, 21 nt, Human
ucacaggguuguugcaagaca

SEQ ID NO: 1387013 - RNA, 25 nt, Human
ucauacacucuuccgguaauuugga

SEQ ID NO: 1387014 - RNA, 21 nt, Human
ucccacaaguuccaacccuaa

SEQ ID NO: 1387015 - RNA, 20 nt, Human
ucccacauuucuccauggcu

SEQ ID NO: 1387016 - RNA, 20 nt, Human
ucuccugggauccaggucuu

SEQ ID NO: 1387017 - RNA, 24 nt, Human
ucuccugggauccaggucuugggg

SEQ ID NO: 1387018 - RNA, 20 nt, Human
ugaagcaucuugaaaguggu

SEQ ID NO: 1387019 - RNA, 23 nt, Human
ugaauacaucacauucaaucuuc

SEQ ID NO: 1387020 - RNA, 24 nt, Human
ugaccauucccuuacccaaccccc

SEQ ID NO: 1387021 - RNA, 21 nt, Human
ugacgguaagagugacauucu

SEQ ID NO: 1387022 - RNA, 18 nt, Human
ugaguucccagauagagc

SEQ ID NO: 1387023 - RNA, 21 nt, Human
ugcagugucuucugcuguaag

SEQ ID NO: 1387024 - RNA, 20 nt, Human
ugcugacuuuuugggauggc

SEQ ID NO: 1387025 - RNA, 19 nt, Human
ugcuguccauacccaucac

SEQ ID NO: 1387026 - RNA, 26 nt, Human
ugggaaguucuucaauagcagcaguu

SEQ ID NO: 1387027 - RNA, 18 nt, Human
ugggggcgacccaacugc

SEQ ID NO: 1387028 - RNA, 22 nt, Human
uggugccaggugauugguuucc

SEQ ID NO: 1387029 - RNA, 22 nt, Human
uguaaaccuuagcuguucuagc

SEQ ID NO: 1387030 - RNA, 21 nt, Human
uguaaagaaguuuugggaagu

SEQ ID NO: 1387031 - RNA, 24 nt, Human
uguggaggcugagggugauggagg

SEQ ID NO: 1387032 - RNA, 20 nt, Human
uguugagaccuagggcagau

SEQ ID NO: 1387033 - RNA, 18 nt, Human
uguugugaggauggaaug

SEQ ID NO: 1387034 - RNA, 19 nt, Human
uugaggccggccucuccca

SEQ ID NO: 1387035 - RNA, 23 nt, Human
uuuccuguuccauccagcauucu

SEQ ID NO: 1387036 - RNA, 18 nt, Human
uuuguaaagaaguuuugg

SEQ ID NO: 1387037 - RNA, 21 nt, Human
aaacaccugccccacguccuc

SEQ ID NO: 1387038 - RNA, 24 nt, Human
aaagugcugggauuacaggcauga

SEQ ID NO: 1387039 - RNA, 18 nt, Human
aaagugugaguugacccc

SEQ ID NO: 1387040 - RNA, 21 nt, Human
aaccuggccaaaaacacccag

SEQ ID NO: 1387041 - RNA, 24 nt, Human
aagugaucugcccgccucggccuc

SEQ ID NO: 1387042 - RNA, 21 nt, Human
aagugcugaagaucagagugg

SEQ ID NO: 1387043 - RNA, 19 nt, Human
aagugcugggauuacaggc

SEQ ID NO: 1387044 - RNA, 21 nt, Human
aagugcugggauuacaggcau

SEQ ID NO: 1387045 - RNA, 18 nt, Human
aauagcugggauuacagg

SEQ ID NO: 1387046 - RNA, 21 nt, Human
aaugcaguggugcaaucucug

SEQ ID NO: 1387047 - RNA, 23 nt, Human
accagcacacaaaucagggaccc

SEQ ID NO: 1387048 - RNA, 24 nt, Human
accauguugccaaggcuggucuug

SEQ ID NO: 1387049 - RNA, 19 nt, Human
accugcgucucuucuccuc

SEQ ID NO: 1387050 - RNA, 22 nt, Human
acgagaggggccguucugggug

SEQ ID NO: 1387051 - RNA, 25 nt, Human
acucugccgcccagguuggaaugca

SEQ ID NO: 1387052 - RNA, 21 nt, Human
agaaaacaccugccccacguc

SEQ ID NO: 1387053 - RNA, 24 nt, Human
agaaaacaccugccccacguccuc

SEQ ID NO: 1387054 - RNA, 20 nt, Human
agaaauauucucuucaucuu

SEQ ID NO: 1387055 - RNA, 23 nt, Human
agaugagaauccugaggcucaga

SEQ ID NO: 1387056 - RNA, 21 nt, Human
aggaggagcgggaggagccca

SEQ ID NO: 1387057 - RNA, 22 nt, Human
aggcugagagccaggaucaggg

SEQ ID NO: 1387058 - RNA, 27 nt, Human
agggaggaagugaacgagaggggaccc

SEQ ID NO: 1387059 - RNA, 20 nt, Human
agguucacagacaugucugc

SEQ ID NO: 1387060 - RNA, 18 nt, Human
augggguuucaccauguu

SEQ ID NO: 1387061 - RNA, 19 nt, Human
augggguuucaccauguug

SEQ ID NO: 1387062 - RNA, 24 nt, Human
caaagugcugggauuacaggcaug

SEQ ID NO: 1387063 - RNA, 22 nt, Human
caaccuggccaaaaacacccag

SEQ ID NO: 1387064 - RNA, 24 nt, Human
caccauguugccaaggcuggucuu

SEQ ID NO: 1387065 - RNA, 27 nt, Human
caccauguugccaaggcuggucuugaa

SEQ ID NO: 1387066 - RNA, 24 nt, Human
cacucugccgcccagguuggaaug

SEQ ID NO: 1387067 - RNA, 19 nt, Human
cagcaaaaggaccaggccg

SEQ ID NO: 1387068 - RNA, 23 nt, Human
cagcaaaaggaccaggccgaccg

SEQ ID NO: 1387069 - RNA, 19 nt, Human
cagcaauaagggccagaaa

SEQ ID NO: 1387070 - RNA, 22 nt, Human
cagcaauaagggccagaaauau

SEQ ID NO: 1387071 - RNA, 18 nt, Human
cagccucaggaggccugg

SEQ ID NO: 1387072 - RNA, 19 nt, Human
cagccugugccuccugggc

SEQ ID NO: 1387073 - RNA, 22 nt, Human
cagcugcacucccgggggugau

SEQ ID NO: 1387074 - RNA, 18 nt, Human
caggagacaccucaaugu

SEQ ID NO: 1387075 - RNA, 22 nt, Human
caggaggagcgggaggagcugg

SEQ ID NO: 1387076 - RNA, 24 nt, Human
caggcaugagucacugugccuggu

SEQ ID NO: 1387077 - RNA, 26 nt, Human
cagggacccuuuuugcucugaaguuu

SEQ ID NO: 1387078 - RNA, 18 nt, Human
cagugucuggcuauuugc

SEQ ID NO: 1387079 - RNA, 24 nt, Human
cauguugccaaggcuggucuugaa

SEQ ID NO: 1387080 - RNA, 18 nt, Human
cauuuggacuuuggguca

SEQ ID NO: 1387081 - RNA, 23 nt, Human
ccaaagugcugggauuacaggca

SEQ ID NO: 1387082 - RNA, 24 nt, Human
ccaaagugcugggauuacaggcau

SEQ ID NO: 1387083 - RNA, 22 nt, Human
ccaagagccccagguucacaga

SEQ ID NO: 1387084 - RNA, 22 nt, Human
ccaaggcuggucuugaacuccu

SEQ ID NO: 1387085 - RNA, 23 nt, Human
ccagcaauccuucugccucaacc

SEQ ID NO: 1387086 - RNA, 27 nt, Human
ccaucacuaccaauuugagagacacca

SEQ ID NO: 1387087 - RNA, 23 nt, Human
ccauugugcccagaagccaggau

SEQ ID NO: 1387088 - RNA, 24 nt, Human
cccaaagugcugggauuacaggca

SEQ ID NO: 1387089 - RNA, 20 nt, Human
cccaagagccccagguucac

SEQ ID NO: 1387090 - RNA, 18 nt, Human
cccaggaacucagggggg

SEQ ID NO: 1387091 - RNA, 23 nt, Human
cccaggaggagcgggaggagccc

SEQ ID NO: 1387092 - RNA, 23 nt, Human
ccccagguucacagacaugucug

SEQ ID NO: 1387093 - RNA, 24 nt, Human
ccccagugucuugcacagugccug

SEQ ID NO: 1387094 - RNA, 18 nt, Human
cccggaggagaaaacacc

SEQ ID NO: 1387095 - RNA, 18 nt, Human
ccucaggaggccuggucu

SEQ ID NO: 1387096 - RNA, 23 nt, Human
ccugaauagcugggauuacaggu

SEQ ID NO: 1387097 - RNA, 24 nt, Human
ccugaauagcugggauuacaggug

SEQ ID NO: 1387098 - RNA, 19 nt, Human
ccugaccucaagugaucug

SEQ ID NO: 1387099 - RNA, 22 nt, Human
ccugaccucaagugaucugccc

SEQ ID NO: 1387100 - RNA, 20 nt, Human
ccugcgucucuucuccucuu

SEQ ID NO: 1387101 - RNA, 19 nt, Human
ccugggcuccagcaauccu

SEQ ID NO: 1387102 - RNA, 24 nt, Human
ccuucugccucaaccuccugaaua

SEQ ID NO: 1387103 - RNA, 24 nt, Human
cgccucggccucccaaagugcugg

SEQ ID NO: 1387104 - RNA, 18 nt, Human
cgggaggagcccagcugc

SEQ ID NO: 1387105 - RNA, 22 nt, Human
cguggcccaguucacaccccuu

SEQ ID NO: 1387106 - RNA, 23 nt, Human
cuaaagacuuuucuccccagcag

SEQ ID NO: 1387107 - RNA, 21 nt, Human
cucacugcagccugugccucc

SEQ ID NO: 1387108 - RNA, 24 nt, Human
cucacugcagccugugccuccugg

SEQ ID NO: 1387109 - RNA, 21 nt, Human
cuccagcaauccuucugcccc

SEQ ID NO: 1387110 - RNA, 24 nt, Human
cuccugaauagcugggauuacagg

SEQ ID NO: 1387111 - RNA, 26 nt, Human
cuccugaccucaagugaucugcccgc

SEQ ID NO: 1387112 - RNA, 21 nt, Human
cuccugggcuccagcaauccu

SEQ ID NO: 1387113 - RNA, 24 nt, Human
cugaauagcugggauuacaggugu

SEQ ID NO: 1387114 - RNA, 18 nt, Human
cugcacucccggggguga

SEQ ID NO: 1387115 - RNA, 23 nt, Human
cugcagccugugccuccugggcu

SEQ ID NO: 1387116 - RNA, 25 nt, Human
cuggccaaaaacacccagcuaacaa

SEQ ID NO: 1387117 - RNA, 19 nt, Human
cuguuucuacaucauuucc

SEQ ID NO: 1387118 - RNA, 19 nt, Human
cuuccccacagacucccca

SEQ ID NO: 1387119 - RNA, 18 nt, Human
cuucugccucaaccuccu

SEQ ID NO: 1387120 - RNA, 24 nt, Human
cuuguccaagccucucuggccacc

SEQ ID NO: 1387121 - RNA, 22 nt, Human
gaagaagucccaggaacucagg

SEQ ID NO: 1387122 - RNA, 19 nt, Human
gaauagcugggauuacagg

SEQ ID NO: 1387123 - RNA, 24 nt, Human
gaauagcugggauuacaggugugc

SEQ ID NO: 1387124 - RNA, 24 nt, Human
gaccucaagugaucugcccgccuc

SEQ ID NO: 1387125 - RNA, 18 nt, Human
gagaugggguuucaccau

SEQ ID NO: 1387126 - RNA, 23 nt, Human
gagaugggguuucaccauguugc

SEQ ID NO: 1387127 - RNA, 22 nt, Human
gaugggguuucaccauguugcc

SEQ ID NO: 1387128 - RNA, 18 nt, Human
gauuacaggcaugaguca

SEQ ID NO: 1387129 - RNA, 21 nt, Human
gauuacaggcaugagucacug

SEQ ID NO: 1387130 - RNA, 24 nt, Human
gauuacaggcaugagucacugugc

SEQ ID NO: 1387131 - RNA, 24 nt, Human
gauuacaggugugcaucaccaugc

SEQ ID NO: 1387132 - RNA, 21 nt, Human
gcaaccuggccaaaaacaccc

SEQ ID NO: 1387133 - RNA, 20 nt, Human
gcaacguguugcugcccaag

SEQ ID NO: 1387134 - RNA, 24 nt, Human
gccccacguccucuuggcuggcca

SEQ ID NO: 1387135 - RNA, 23 nt, Human
gcuggucuugaacuccugaccuc

SEQ ID NO: 1387136 - RNA, 19 nt, Human
ggaggaagugaacgagagg

SEQ ID NO: 1387137 - RNA, 18 nt, Human
ggagggcgaggaugagga

SEQ ID NO: 1387138 - RNA, 24 nt, Human
ggauuacaggcaugagucacugug

SEQ ID NO: 1387139 - RNA, 19 nt, Human
ggcaggugcagggaggaag

SEQ ID NO: 1387140 - RNA, 19 nt, Human
ggccaagauccccagcagc

SEQ ID NO: 1387141 - RNA, 24 nt, Human
ggcuggucuugaacuccugaccuc

SEQ ID NO: 1387142 - RNA, 22 nt, Human
gggacugacuucucaucugguc

SEQ ID NO: 1387143 - RNA, 22 nt, Human
gggcuccagcaauccuucugcc

SEQ ID NO: 1387144 - RNA, 21 nt, Human
ggguuucaccauguugccaag

SEQ ID NO: 1387145 - RNA, 19 nt, Human
ggucuugaacuccugaccu

SEQ ID NO: 1387146 - RNA, 22 nt, Human
ggugguucugcucuguuugcuu

SEQ ID NO: 1387147 - RNA, 24 nt, Human
gucagguguaaucccccacaaaag

SEQ ID NO: 1387148 - RNA, 19 nt, Human
gucucauuucuuaucccca

SEQ ID NO: 1387149 - RNA, 24 nt, Human
gugaucugcccgccucggccuccc

SEQ ID NO: 1387150 - RNA, 19 nt, Human
guggagaugggguuucacc

SEQ ID NO: 1387151 - RNA, 21 nt, Human
guggagaugggguuucaccau

SEQ ID NO: 1387152 - RNA, 22 nt, Human
guggagaugggguuucaccaug

SEQ ID NO: 1387153 - RNA, 23 nt, Human
guggagaugggguuucaccaugu

SEQ ID NO: 1387154 - RNA, 18 nt, Human
guggcuugcuagguggaa

SEQ ID NO: 1387155 - RNA, 23 nt, Human
gugugcaaccuggccaaaaacac

SEQ ID NO: 1387156 - RNA, 28 nt, Human
uaaagacuuuucuccccagcagagauuc

SEQ ID NO: 1387157 - RNA, 21 nt, Human
uaacaagugcugaagaucaga

SEQ ID NO: 1387158 - RNA, 22 nt, Human
uaauuuuuuguauuuuuggugg

SEQ ID NO: 1387159 - RNA, 24 nt, Human
uaauuuuuuguauuuuugguggag

SEQ ID NO: 1387160 - RNA, 25 nt, Human
uaauuuuuuguauuuuugguggaga

SEQ ID NO: 1387161 - RNA, 18 nt, Human
uacagcaccugcgucucu

SEQ ID NO: 1387162 - RNA, 22 nt, Human
uacaggcaugagucacugugcc

SEQ ID NO: 1387163 - RNA, 19 nt, Human
uaucagggguggaaggggc

SEQ ID NO: 1387164 - RNA, 20 nt, Human
uaugcaagggcacaagaguc

SEQ ID NO: 1387165 - RNA, 21 nt, Human
uaugcagccucaggaggccug

SEQ ID NO: 1387166 - RNA, 24 nt, Human
ucacugcagccugugccuccuggg

SEQ ID NO: 1387167 - RNA, 25 nt, Human
ucacugcagccugugccuccugggc

SEQ ID NO: 1387168 - RNA, 23 nt, Human
ucauuuugcuucucuuuucucug

SEQ ID NO: 1387169 - RNA, 24 nt, Human
ucccaaagugcugggauuacaggc

SEQ ID NO: 1387170 - RNA, 21 nt, Human
ucccaggaacucaggggggcc

SEQ ID NO: 1387171 - RNA, 23 nt, Human
ucccaggaacucaggggggccaa

SEQ ID NO: 1387172 - RNA, 24 nt, Human
uccccaaguuccgagguaaaggga

SEQ ID NO: 1387173 - RNA, 22 nt, Human
uccccacagacuccccaggagc

SEQ ID NO: 1387174 - RNA, 21 nt, Human
uccccaggagcauugcccagg

SEQ ID NO: 1387175 - RNA, 22 nt, Human
uccccagucagggugcaguguc

SEQ ID NO: 1387176 - RNA, 22 nt, Human
uccccagugucuugcacagugc

SEQ ID NO: 1387177 - RNA, 24 nt, Human
uccugaauagcugggauuacaggu

SEQ ID NO: 1387178 - RNA, 20 nt, Human
uccugggcuccagcaauccu

SEQ ID NO: 1387179 - RNA, 24 nt, Human
uccuucugccucaaccuccugaau

SEQ ID NO: 1387180 - RNA, 18 nt, Human
ucggccucccaaagugcu

SEQ ID NO: 1387181 - RNA, 18 nt, Human
ucuacugagaccucuuca

SEQ ID NO: 1387182 - RNA, 23 nt, Human
ucucacucugccgcccagguugg

SEQ ID NO: 1387183 - RNA, 24 nt, Human
ucucacucugccgcccagguugga

SEQ ID NO: 1387184 - RNA, 24 nt, Human
ucucuucaucuuacagaugagaau

SEQ ID NO: 1387185 - RNA, 21 nt, Human
ucuugaacuccugaccucaag

SEQ ID NO: 1387186 - RNA, 18 nt, Human
ugaccucaagugaucugc

SEQ ID NO: 1387187 - RNA, 24 nt, Human
ugaccucaagugaucugcccgccu

SEQ ID NO: 1387188 - RNA, 19 nt, Human
ugaguugacccccaucacu

SEQ ID NO: 1387189 - RNA, 18 nt, Human
ugcaaucucugcucacug

SEQ ID NO: 1387190 - RNA, 24 nt, Human
ugccaaggcuggucuugaacuccu

SEQ ID NO: 1387191 - RNA, 27 nt, Human
ugccucaaccuccugaauagcugggau

SEQ ID NO: 1387192 - RNA, 24 nt, Human
ugccuccugggcuccagcaauccu

SEQ ID NO: 1387193 - RNA, 22 nt, Human
ugccugcugcugccuucucugc

SEQ ID NO: 1387194 - RNA, 24 nt, Human
ugcucugaaguuuccugaugcaaa

SEQ ID NO: 1387195 - RNA, 24 nt, Human
ugcugaagaucagagugggacugg

SEQ ID NO: 1387196 - RNA, 24 nt, Human
ugcugggauuacaggcaugaguca

SEQ ID NO: 1387197 - RNA, 18 nt, Human
uggaaugcaguggugcaa

SEQ ID NO: 1387198 - RNA, 19 nt, Human
uggaaugcaguggugcaau

SEQ ID NO: 1387199 - RNA, 30 nt, Human
uggccaaaaacacccagcuaacaagugcuu

SEQ ID NO: 1387200 - RNA, 18 nt, Human
ugggauuacaggcaugag

SEQ ID NO: 1387201 - RNA, 21 nt, Human
ugggauuacaggcaugaguca

SEQ ID NO: 1387202 - RNA, 22 nt, Human
ugggauuacaggcaugagucac

SEQ ID NO: 1387203 - RNA, 22 nt, Human
ugggauuacaggcaugagucac

SEQ ID NO: 1387204 - RNA, 22 nt, Human
ugggauuacaggcaugagucac

SEQ ID NO: 1387205 - RNA, 23 nt, Human
ugggauuacaggcaugagucacu

SEQ ID NO: 1387206 - RNA, 24 nt, Human
ugggauuacaggcaugagucacug

SEQ ID NO: 1387207 - RNA, 22 nt, Human
ugggauuacaggugugcaucaa

SEQ ID NO: 1387208 - RNA, 22 nt, Human
ugggauuacaggugugcaucac

SEQ ID NO: 1387209 - RNA, 24 nt, Human
ugggauuacaggugugcaucacca

SEQ ID NO: 1387210 - RNA, 24 nt, Human
ugggauuacaggugugcaucacca

SEQ ID NO: 1387211 - RNA, 25 nt, Human
ugggauuacaggugugcaucaccau

SEQ ID NO: 1387212 - RNA, 24 nt, Human
ugggcuccagcaauccuucugccu

SEQ ID NO: 1387213 - RNA, 23 nt, Human
ugggguuucaccauguugccaag

SEQ ID NO: 1387214 - RNA, 23 nt, Human
ugguggagaugggguuucaccau

SEQ ID NO: 1387215 - RNA, 24 nt, Human
ugguggagaugggguuucaccaug

SEQ ID NO: 1387216 - RNA, 22 nt, Human
ugugcaaccuggccaaaaacac

SEQ ID NO: 1387217 - RNA, 22 nt, Human
uguugcugcccaagagccccag

SEQ ID NO: 1387218 - RNA, 24 nt, Human
uuacagaugagaauccugaggcuc

SEQ ID NO: 1387219 - RNA, 24 nt, Human
uucccugccuuaucucuuuucgau

SEQ ID NO: 1387220 - RNA, 24 nt, Human
uugguggagaugggguuucaccau

SEQ ID NO: 1387221 - RNA, 21 nt, Human
uuucaccauguugccaaggcu

SEQ ID NO: 1387222 - RNA, 24 nt, Human
uuuuguaugcuugacaucuggugu

SEQ ID NO: 1387223 - RNA, 22 nt, Human
uuuuugguggagaugggguuuc

SEQ ID NO: 1387224 - RNA, 24 nt, Human
uuuuugguggagaugggguuucac

SEQ ID NO: 1387225 - RNA, 21 nt, Human
uuuuuguauuuuugguggaga

SEQ ID NO: 1387226 - RNA, 24 nt, Human
uuuuuuguauuuuugguggagaug

SEQ ID NO: 1387227 - RNA, 20 nt, Human
aaaaaaauacaccugaccau

SEQ ID NO: 1387228 - RNA, 23 nt, Human
aaaacaaaaaaaacaaaacaccc

SEQ ID NO: 1387229 - RNA, 18 nt, Human
aaaacacccaaaacagcu

SEQ ID NO: 1387230 - RNA, 23 nt, Human
aaacaaaaaaaacaaaacaccca

SEQ ID NO: 1387231 - RNA, 25 nt, Human
aaacaaaaaaaacaaaacacccaaa

SEQ ID NO: 1387232 - RNA, 21 nt, Human
aaacaaaacacccaaaacagc

SEQ ID NO: 1387233 - RNA, 26 nt, Human
aaagcaaaaugcuauaaaaacaaaaa

SEQ ID NO: 1387234 - RNA, 24 nt, Human
aacaaaaaaaacaaaacacccaaa

SEQ ID NO: 1387235 - RNA, 23 nt, Human
aacaaacccaaccaccugugcac

SEQ ID NO: 1387236 - RNA, 25 nt, Human
aacacaguucgucaguuggccaccu

SEQ ID NO: 1387237 - RNA, 18 nt, Human
aacauucacacguuucca

SEQ ID NO: 1387238 - RNA, 23 nt, Human
aaugacuguuugggacccccaug

SEQ ID NO: 1387239 - RNA, 23 nt, Human
acaaaaaaaacaaaacacccaaa

SEQ ID NO: 1387240 - RNA, 24 nt, Human
acaaaacacccaaaaccagcuacu

SEQ ID NO: 1387241 - RNA, 24 nt, Human
acaaagauucuaaacacuggcuuu

SEQ ID NO: 1387242 - RNA, 24 nt, Human
accaggucuacguccugaaaauac

SEQ ID NO: 1387243 - RNA, 22 nt, Human
acccaaaacagcucucccuccu

SEQ ID NO: 1387244 - RNA, 18 nt, Human
acuguauuauaacaaagu

SEQ ID NO: 1387245 - RNA, 19 nt, Human
agaaaaacaggggagacaa

SEQ ID NO: 1387246 - RNA, 21 nt, Human
agaaaaacaggggagacaaaa

SEQ ID NO: 1387247 - RNA, 22 nt, Human
agaaaaacaggggagacaaaac

SEQ ID NO: 1387248 - RNA, 20 nt, Human
aggaagcauaaaaaaacagc

SEQ ID NO: 1387249 - RNA, 24 nt, Human
auaaaaacaaaaaaaacaaaacac

SEQ ID NO: 1387250 - RNA, 21 nt, Human
auccacacacugccacucuuc

SEQ ID NO: 1387251 - RNA, 25 nt, Human
aucugcacaaagauucuaaacacca

SEQ ID NO: 1387252 - RNA, 20 nt, Human
caaaaaaaacaaaacaccca

SEQ ID NO: 1387253 - RNA, 23 nt, Human
caaaaaaaacaaaacacccaaaa

SEQ ID NO: 1387254 - RNA, 21 nt, Human
caaacaaacccaaccaccugu

SEQ ID NO: 1387255 - RNA, 18 nt, Human
cacaccucucucccccca

SEQ ID NO: 1387256 - RNA, 24 nt, Human
caccaacgaccagacuagcaacag

SEQ ID NO: 1387257 - RNA, 23 nt, Human
caccagcagcgagcgcggaagcc

SEQ ID NO: 1387258 - RNA, 19 nt, Human
cagaaaaacaggggagaca

SEQ ID NO: 1387259 - RNA, 19 nt, Human
cagcaaacacauguaccua

SEQ ID NO: 1387260 - RNA, 22 nt, Human
cagcaaacacauguaccuagaa

SEQ ID NO: 1387261 - RNA, 23 nt, Human
cagcagcgagcgcggaagccucg

SEQ ID NO: 1387262 - RNA, 24 nt, Human
cagcuugaagcuuuccuuccucag

SEQ ID NO: 1387263 - RNA, 19 nt, Human
caggaacaaauaugaccac

SEQ ID NO: 1387264 - RNA, 22 nt, Human
ccaaacuuugaaaauacaauaa

SEQ ID NO: 1387265 - RNA, 21 nt, Human
ccaagaaaaagcaaaaugcua

SEQ ID NO: 1387266 - RNA, 18 nt, Human
cccauggccagcuugaag

SEQ ID NO: 1387267 - RNA, 19 nt, Human
ccccacguagugacccacc

SEQ ID NO: 1387268 - RNA, 20 nt, Human
ccccccacguagugacccac

SEQ ID NO: 1387269 - RNA, 26 nt, Human
ccccgccgcgcuccgcuccagacccg

SEQ ID NO: 1387270 - RNA, 19 nt, Human
cccgcgcggccucgccggc

SEQ ID NO: 1387271 - RNA, 23 nt, Human
cccugccuacccagcgccuucca

SEQ ID NO: 1387272 - RNA, 18 nt, Human
ccgccgcgcuccgcucca

SEQ ID NO: 1387273 - RNA, 23 nt, Human
cgcaggcagaaaaacaggggaga

SEQ ID NO: 1387274 - RNA, 21 nt, Human
cgccgccgccucuuccagccc

SEQ ID NO: 1387275 - RNA, 22 nt, Human
cgccuauuaauaaaaaaauaca

SEQ ID NO: 1387276 - RNA, 18 nt, Human
cgcuccgcuccagacccg

SEQ ID NO: 1387277 - RNA, 20 nt, Human
cuccccucccugccuaccca

SEQ ID NO: 1387278 - RNA, 25 nt, Human
cuccgcuccagacccgcgcggccuc

SEQ ID NO: 1387279 - RNA, 23 nt, Human
cucgcugucaccaacgaccagac

SEQ ID NO: 1387280 - RNA, 18 nt, Human
cucucccuccuuugaucu

SEQ ID NO: 1387281 - RNA, 20 nt, Human
cugugcacaaugcuuccacc

SEQ ID NO: 1387282 - RNA, 18 nt, Human
cuucaagaccaaccgucc

SEQ ID NO: 1387283 - RNA, 18 nt, Human
gaaauugaguggcuaaug

SEQ ID NO: 1387284 - RNA, 18 nt, Human
gaccagacuagcaacagg

SEQ ID NO: 1387285 - RNA, 21 nt, Human
gacuccuuaucaggugaacac

SEQ ID NO: 1387286 - RNA, 24 nt, Human
gagacaaaacgaaaggcucucuug

SEQ ID NO: 1387287 - RNA, 23 nt, Human
gcagcagcguacguacuguauag

SEQ ID NO: 1387288 - RNA, 19 nt, Human
gccaagucaauugcuuugg

SEQ ID NO: 1387289 - RNA, 22 nt, Human
gcuauaaaaacaaaaaaaacaa

SEQ ID NO: 1387290 - RNA, 23 nt, Human
gcuucacaccucucuccccccac

SEQ ID NO: 1387291 - RNA, 21 nt, Human
gggagaaauucaucaucacaa

SEQ ID NO: 1387292 - RNA, 21 nt, Human
gguacuggaaauugaguggcu

SEQ ID NO: 1387293 - RNA, 19 nt, Human
gucaaacaaacccaaccac

SEQ ID NO: 1387294 - RNA, 23 nt, Human
guuuccagcauguaccuccgcuu

SEQ ID NO: 1387295 - RNA, 23 nt, Human
uaaaaaaacagcaaagcacacga

SEQ ID NO: 1387296 - RNA, 26 nt, Human
uaaaaaaacagcaaagcacacgagua

SEQ ID NO: 1387297 - RNA, 26 nt, Human
uaaauuuugagcuugauauucucaua

SEQ ID NO: 1387298 - RNA, 18 nt, Human
uaacaagacagagcucug

SEQ ID NO: 1387299 - RNA, 26 nt, Human
uaagaucacaggaacaaauaugacca

SEQ ID NO: 1387300 - RNA, 21 nt, Human
uaccccaaagucagcaaacac

SEQ ID NO: 1387301 - RNA, 22 nt, Human
uaccccaaagucagcaaacaca

SEQ ID NO: 1387302 - RNA, 23 nt, Human
uaccuagaacucaucccaauugu

SEQ ID NO: 1387303 - RNA, 20 nt, Human
uagaacucaucccaauugua

SEQ ID NO: 1387304 - RNA, 21 nt, Human
uaucauaacaagacagagcuc

SEQ ID NO: 1387305 - RNA, 22 nt, Human
ucaaacaaacccaaccaccugu

SEQ ID NO: 1387306 - RNA, 19 nt, Human
ucaaauccacacacugcca

SEQ ID NO: 1387307 - RNA, 21 nt, Human
ucacaccucucuccccccacg

SEQ ID NO: 1387308 - RNA, 23 nt, Human
ucaguuggccaccuaaaguacaa

SEQ ID NO: 1387309 - RNA, 24 nt, Human
ucaucaucuaagccuggaaugacu

SEQ ID NO: 1387310 - RNA, 20 nt, Human
uccacacacugccacucuuc

SEQ ID NO: 1387311 - RNA, 28 nt, Human
uccacacacugccacucuucaagaccag

SEQ ID NO: 1387312 - RNA, 23 nt, Human
uccacugggccuucuuaaucuca

SEQ ID NO: 1387313 - RNA, 21 nt, Human
uccucagccacucugggcccc

SEQ ID NO: 1387314 - RNA, 20 nt, Human
ucucucaugaguccccaaau

SEQ ID NO: 1387315 - RNA, 21 nt, Human
ucugcagagguccucaaaucc

SEQ ID NO: 1387316 - RNA, 23 nt, Human
ucugcagagguccucaaauccac

SEQ ID NO: 1387317 - RNA, 21 nt, Human
ucuucaagaccaaccguccac

SEQ ID NO: 1387318 - RNA, 23 nt, Human
ugccauaggaaaauuacauucca

SEQ ID NO: 1387319 - RNA, 20 nt, Human
uggaaugacuguuugggacc

SEQ ID NO: 1387320 - RNA, 21 nt, Human
uguaccuccgcuucacaccuc

SEQ ID NO: 1387321 - RNA, 18 nt, Human
uguagugucuucucacuu

SEQ ID NO: 1387322 - RNA, 26 nt, Human
uguggcagcugcaaccauguaguguc

SEQ ID NO: 1387323 - RNA, 21 nt, Human
uucacaccucucuccccccac

SEQ ID NO: 1387324 - RNA, 22 nt, Human
uucacaccucucuccccccacg

SEQ ID NO: 1387325 - RNA, 23 nt, Human
uuccaagaaaaagcaaaaugcua

SEQ ID NO: 1387326 - RNA, 20 nt, Human
uuccaggaagcauaaaaaaa

SEQ ID NO: 1387327 - RNA, 21 nt, Human
uucuuaaucucauccaaaguc

SEQ ID NO: 1387328 - RNA, 18 nt, Human
uuguagguugcucaccag

SEQ ID NO: 1387329 - RNA, 24 nt, Human
uuuuuuuuuuuuuuuuuucauuuu

SEQ ID NO: 1387330 - RNA, 19 nt, Human
aaaaagaaaggaaaaggca

SEQ ID NO: 1387331 - RNA, 21 nt, Human
aaaaagaaaggaaaaggcaca

SEQ ID NO: 1387332 - RNA, 21 nt, Human
aaacgggagccugcaggcagc

SEQ ID NO: 1387333 - RNA, 21 nt, Human
aacacugcuccugucacccac

SEQ ID NO: 1387334 - RNA, 23 nt, Human
aacgggagccugcaggcagcccc

SEQ ID NO: 1387335 - RNA, 18 nt, Human
aagacaaaagacuuccuc

SEQ ID NO: 1387336 - RNA, 24 nt, Human
aagcggcuccccucccccaaguca

SEQ ID NO: 1387337 - RNA, 23 nt, Human
aauuucuaucuuaaaaaaaggaa

SEQ ID NO: 1387338 - RNA, 18 nt, Human
accagagaacccugagca

SEQ ID NO: 1387339 - RNA, 20 nt, Human
acccugagcagcuggaagac

SEQ ID NO: 1387340 - RNA, 25 nt, Human
acgccagccuguuguccucuggccu

SEQ ID NO: 1387341 - RNA, 21 nt, Human
agaagaacacucaaaaggaaa

SEQ ID NO: 1387342 - RNA, 21 nt, Human
agagaaaaacuuguaggcagg

SEQ ID NO: 1387343 - RNA, 19 nt, Human
agagaagaacacucaaaag

SEQ ID NO: 1387344 - RNA, 20 nt, Human
agagaagaacacucaaaagg

SEQ ID NO: 1387345 - RNA, 22 nt, Human
agagagcagcucgaggcucagg

SEQ ID NO: 1387346 - RNA, 20 nt, Human
agagcagcucgaggcucagg

SEQ ID NO: 1387347 - RNA, 21 nt, Human
auucugggagguaaacagucu

SEQ ID NO: 1387348 - RNA, 23 nt, Human
caaaacgccagccuguuguccuc

SEQ ID NO: 1387349 - RNA, 24 nt, Human
caaaaggaaaugauccaaucucac

SEQ ID NO: 1387350 - RNA, 21 nt, Human
caaauaacuucacuuuaaugu

SEQ ID NO: 1387351 - RNA, 25 nt, Human
cacauuugcuucccccaugauccaa

SEQ ID NO: 1387352 - RNA, 18 nt, Human
caccagaaccaccgccag

SEQ ID NO: 1387353 - RNA, 21 nt, Human
caccagaaccaccgccagcca

SEQ ID NO: 1387354 - RNA, 23 nt, Human
caccagaaccaccgccagccaac

SEQ ID NO: 1387355 - RNA, 21 nt, Human
cacccgggcucccucgugcuc

SEQ ID NO: 1387356 - RNA, 21 nt, Human
caccgccagccaacuggucag

SEQ ID NO: 1387357 - RNA, 19 nt, Human
cagagaaaaacuuguaggc

SEQ ID NO: 1387358 - RNA, 20 nt, Human
cagagagcagcucgaggcuc

SEQ ID NO: 1387359 - RNA, 20 nt, Human
cagcggccucagcuucaggc

SEQ ID NO: 1387360 - RNA, 23 nt, Human
cagggcaccacccgggcucccuc

SEQ ID NO: 1387361 - RNA, 26 nt, Human
caguaggauguguaaaaagaaaggaa

SEQ ID NO: 1387362 - RNA, 21 nt, Human
caguguaugacucgcaggaac

SEQ ID NO: 1387363 - RNA, 23 nt, Human
ccacaauagcuuuuguaccaaag

SEQ ID NO: 1387364 - RNA, 18 nt, Human
ccaggcgggcaugcucau

SEQ ID NO: 1387365 - RNA, 27 nt, Human
cccaaacauucugggagguaaacaguc

SEQ ID NO: 1387366 - RNA, 22 nt, Human
cccaagcugcccccauguaaag

SEQ ID NO: 1387367 - RNA, 23 nt, Human
cccaagcugcccccauguaaagu

SEQ ID NO: 1387368 - RNA, 23 nt, Human
cccacaauagcuuuuguaccaaa

SEQ ID NO: 1387369 - RNA, 19 nt, Human
cccccauguaaagugccgc

SEQ ID NO: 1387370 - RNA, 20 nt, Human
cccucgugcuccaccagaac

SEQ ID NO: 1387371 - RNA, 18 nt, Human
cccuggagauccagccgc

SEQ ID NO: 1387372 - RNA, 18 nt, Human
cccuggagauccagccgc

SEQ ID NO: 1387373 - RNA, 18 nt, Human
ccgcgugcccggggcugc

SEQ ID NO: 1387374 - RNA, 19 nt, Human
ccguuucgccgguaccgcu

SEQ ID NO: 1387375 - RNA, 23 nt, Human
ccucuggccugauuuuccucauc

SEQ ID NO: 1387376 - RNA, 18 nt, Human
ccugcaggcagccccgcc

SEQ ID NO: 1387377 - RNA, 26 nt, Human
ccuugaaagaggaccccagagaaaaa

SEQ ID NO: 1387378 - RNA, 18 nt, Human
cgcagcuccuucuccucc

SEQ ID NO: 1387379 - RNA, 24 nt, Human
cggccucagcuucaggcgcagcuc

SEQ ID NO: 1387380 - RNA, 20 nt, Human
cggcuccccucccccaaguc

SEQ ID NO: 1387381 - RNA, 18 nt, Human
cugcagagcaccuucucc

SEQ ID NO: 1387382 - RNA, 22 nt, Human
cuucacagucacguagcgggcu

SEQ ID NO: 1387383 - RNA, 19 nt, Human
gagcaacaguggggaagcg

SEQ ID NO: 1387384 - RNA, 19 nt, Human
gagcagcucgaggcucagg

SEQ ID NO: 1387385 - RNA, 21 nt, Human
gagcagcucgaggcucagggc

SEQ ID NO: 1387386 - RNA, 18 nt, Human
gaggagucugggcccaag

SEQ ID NO: 1387387 - RNA, 21 nt, Human
gccagccuguuguccucuggc

SEQ ID NO: 1387388 - RNA, 18 nt, Human
gcccggggcugcgcuggg

SEQ ID NO: 1387389 - RNA, 19 nt, Human
gcgcuggggucagcugugg

SEQ ID NO: 1387390 - RNA, 18 nt, Human
gcuacacagcggaggagu

SEQ ID NO: 1387391 - RNA, 19 nt, Human
gcugcaguucucggaucuu

SEQ ID NO: 1387392 - RNA, 19 nt, Human
ggaagcggcuccccucccc

SEQ ID NO: 1387393 - RNA, 22 nt, Human
ggaagguaccguggacauccuu

SEQ ID NO: 1387394 - RNA, 20 nt, Human
ggccugauuuuccucaucug

SEQ ID NO: 1387395 - RNA, 19 nt, Human
ggcucagggcaccacccgg

SEQ ID NO: 1387396 - RNA, 21 nt, Human
guggcuugcggguccagcagg

SEQ ID NO: 1387397 - RNA, 20 nt, Human
uaaaauacacacauuugcuu

SEQ ID NO: 1387398 - RNA, 23 nt, Human
uaaagugccgcgugcccggggcu

SEQ ID NO: 1387399 - RNA, 21 nt, Human
uaccaaagagaagaacacuca

SEQ ID NO: 1387400 - RNA, 20 nt, Human
uagcgggcuggacucaaguu

SEQ ID NO: 1387401 - RNA, 21 nt, Human
ucaaaaaggucaucaaacucc

SEQ ID NO: 1387402 - RNA, 19 nt, Human
ucaaaaggaaaugauccaa

SEQ ID NO: 1387403 - RNA, 20 nt, Human
ucaagacagugacagagagc

SEQ ID NO: 1387404 - RNA, 22 nt, Human
ucagaggaccaugaaaagaauu

SEQ ID NO: 1387405 - RNA, 20 nt, Human
ucagcgccuuuuccuucucc

SEQ ID NO: 1387406 - RNA, 22 nt, Human
ucaguucccaacaaaacgccag

SEQ ID NO: 1387407 - RNA, 23 nt, Human
uccagguagcuaggaaggcggcu

SEQ ID NO: 1387408 - RNA, 18 nt, Human
ucccuggagauccagccg

SEQ ID NO: 1387409 - RNA, 26 nt, Human
ucucggaucuuggcccggagcauuuu

SEQ ID NO: 1387410 - RNA, 20 nt, Human
ucugagcacgccaaagacuc

SEQ ID NO: 1387411 - RNA, 20 nt, Human
ucugagcaucacccuggcuu

SEQ ID NO: 1387412 - RNA, 18 nt, Human
ucuuacagaugccuacua

SEQ ID NO: 1387413 - RNA, 18 nt, Human
ucuuggaccagagaaccc

SEQ ID NO: 1387414 - RNA, 21 nt, Human
ugaaauguuuuauuuaaugcu

SEQ ID NO: 1387415 - RNA, 19 nt, Human
ugauucaagacagugacag

SEQ ID NO: 1387416 - RNA, 20 nt, Human
ugcccggggcugcgcugggg

SEQ ID NO: 1387417 - RNA, 21 nt, Human
ugcccggggcugcgcuggggu

SEQ ID NO: 1387418 - RNA, 22 nt, Human
ugcccggggcugcgcugggguc

SEQ ID NO: 1387419 - RNA, 24 nt, Human
uggcuagucugaggccucagcugg

SEQ ID NO: 1387420 - RNA, 24 nt, Human
uggggaagcggcuccccuccccca

SEQ ID NO: 1387421 - RNA, 24 nt, Human
uggugaucccguuucgccgguacc

SEQ ID NO: 1387422 - RNA, 22 nt, Human
ugucaccaggaaauagcuggug

SEQ ID NO: 1387423 - RNA, 20 nt, Human
ugugcauguuuucaaaaagg

SEQ ID NO: 1387424 - RNA, 20 nt, Human
uuacuauugcuucuuucaga

SEQ ID NO: 1387425 - RNA, 23 nt, Human
uuagaaaugaugagguuuucuuu

SEQ ID NO: 1387426 - RNA, 19 nt, Human
uucaagacgcgucccugga

SEQ ID NO: 1387427 - RNA, 20 nt, Human
uucaggaggaagguaccgug

SEQ ID NO: 1387428 - RNA, 22 nt, Human
uucaggaggaagguaccgugga

SEQ ID NO: 1387429 - RNA, 18 nt, Human
uuccucaaguuucaggag

SEQ ID NO: 1387430 - RNA, 23 nt, Human
uuccucaaguuucaggaggaagg

SEQ ID NO: 1387431 - RNA, 21 nt, Human
uuguaccaaagagaagaacac

SEQ ID NO: 1387432 - RNA, 23 nt, Human
aaaaacacacaccccacaugccc

SEQ ID NO: 1387433 - RNA, 22 nt, Human
aaaaagccaccuccccaaacac

SEQ ID NO: 1387434 - RNA, 23 nt, Human
aaaacacacaccccacaugccca

SEQ ID NO: 1387435 - RNA, 19 nt, Human
aaacacacaccccacaugc

SEQ ID NO: 1387436 - RNA, 23 nt, Human
aaacacaguccccucguucccca

SEQ ID NO: 1387437 - RNA, 24 nt, Human
aaacacaguccccucguuccccac

SEQ ID NO: 1387438 - RNA, 22 nt, Human
aagguaaaaacacacaccccac

SEQ ID NO: 1387439 - RNA, 22 nt, Human
acaguccccucguuccccaccu

SEQ ID NO: 1387440 - RNA, 22 nt, Human
accacugccugggacucuccug

SEQ ID NO: 1387441 - RNA, 18 nt, Human
agauaugaaaagucgacu

SEQ ID NO: 1387442 - RNA, 19 nt, Human
agccccuccucccaucccc

SEQ ID NO: 1387443 - RNA, 18 nt, Human
aggagaaagauaugaaaa

SEQ ID NO: 1387444 - RNA, 22 nt, Human
aggcaccccugcccugggccug

SEQ ID NO: 1387445 - RNA, 24 nt, Human
aggcggcccccggggcuguggcuc

SEQ ID NO: 1387446 - RNA, 24 nt, Human
caaaugguaaaaggcuuaaaaaca

SEQ ID NO: 1387447 - RNA, 23 nt, Human
caacgcgcacaacacaugcauuu

SEQ ID NO: 1387448 - RNA, 25 nt, Human
cacacaccccacaugccccccugag

SEQ ID NO: 1387449 - RNA, 20 nt, Human
caccaagguaaaaacacaca

SEQ ID NO: 1387450 - RNA, 25 nt, Human
caccccacaugcccacguggcccca

SEQ ID NO: 1387451 - RNA, 21 nt, Human
caccuugugcaaucuaggccc

SEQ ID NO: 1387452 - RNA, 22 nt, Human
cacugagccgcuccucagcccc

SEQ ID NO: 1387453 - RNA, 18 nt, Human
cagccccuccucccaucc

SEQ ID NO: 1387454 - RNA, 20 nt, Human
cagcgccccggccugcgugc

SEQ ID NO: 1387455 - RNA, 22 nt, Human
caggaucugcugccaccacugg

SEQ ID NO: 1387456 - RNA, 21 nt, Human
cagucaacagcagacgaaaga

SEQ ID NO: 1387457 - RNA, 20 nt, Human
caugcccacguggccccaca

SEQ ID NO: 1387458 - RNA, 19 nt, Human
ccaccuccccaaacacagu

SEQ ID NO: 1387459 - RNA, 21 nt, Human
ccaccuccccaaacacagucc

SEQ ID NO: 1387460 - RNA, 24 nt, Human
ccauccccaacgcgcacaacacau

SEQ ID NO: 1387461 - RNA, 18 nt, Human
cccacacguggcaagggu

SEQ ID NO: 1387462 - RNA, 24 nt, Human
cccacacguggcaagggugggggu

SEQ ID NO: 1387463 - RNA, 22 nt, Human
cccacaugcccacguggcccca

SEQ ID NO: 1387464 - RNA, 25 nt, Human
ccccacacguggcaagggugggggu

SEQ ID NO: 1387465 - RNA, 22 nt, Human
ccccucguuccccaccuuccga

SEQ ID NO: 1387466 - RNA, 25 nt, Human
cccgcagcgccccggccugcgugcu

SEQ ID NO: 1387467 - RNA, 18 nt, Human
cccggaaccacagggcgc

SEQ ID NO: 1387468 - RNA, 18 nt, Human
ccuaauacuuagccccgc

SEQ ID NO: 1387469 - RNA, 21 nt, Human
ccucagccccuccucccaucc

SEQ ID NO: 1387470 - RNA, 21 nt, Human
ccugcccugggccugcaacac

SEQ ID NO: 1387471 - RNA, 23 nt, Human
ccuugccccugggugccacuggc

SEQ ID NO: 1387472 - RNA, 21 nt, Human
cgaaaaagccaccuccccaaa

SEQ ID NO: 1387473 - RNA, 22 nt, Human
cgguggcugugggaggugacac

SEQ ID NO: 1387474 - RNA, 21 nt, Human
cuaccucugcuuuuuuggggg

SEQ ID NO: 1387475 - RNA, 19 nt, Human
cugcgugcugggcgacucc

SEQ ID NO: 1387476 - RNA, 19 nt, Human
cugggucccguccgccagg

SEQ ID NO: 1387477 - RNA, 24 nt, Human
cuuagccccgcagcgccccggccg

SEQ ID NO: 1387478 - RNA, 27 nt, Human
cuuuuuuggggggcaggggaucaggca

SEQ ID NO: 1387479 - RNA, 19 nt, Human
gaaaaagccaccuccccaa

SEQ ID NO: 1387480 - RNA, 23 nt, Human
gaaaaagccaccuccccaaacac

SEQ ID NO: 1387481 - RNA, 25 nt, Human
gcagacgaaaaagccaccuccccaa

SEQ ID NO: 1387482 - RNA, 19 nt, Human
gcccugggccugcaacacc

SEQ ID NO: 1387483 - RNA, 20 nt, Human
gcuccucagccccuccuccc

SEQ ID NO: 1387484 - RNA, 21 nt, Human
ggaaggccuaauacuuagccc

SEQ ID NO: 1387485 - RNA, 22 nt, Human
ggcaggcaccccugcccugggc

SEQ ID NO: 1387486 - RNA, 24 nt, Human
ggggcaggcaccccugcccugggc

SEQ ID NO: 1387487 - RNA, 19 nt, Human
gugcugggcgacuccaccc

SEQ ID NO: 1387488 - RNA, 23 nt, Human
guggccccacacguggcaagggu

SEQ ID NO: 1387489 - RNA, 19 nt, Human
ucaaggggccccgggaggc

SEQ ID NO: 1387490 - RNA, 18 nt, Human
ucacgagaaaucguuggc

SEQ ID NO: 1387491 - RNA, 18 nt, Human
ucagccccuccucccauc

SEQ ID NO: 1387492 - RNA, 19 nt, Human
ucagccccuccucccaucc

SEQ ID NO: 1387493 - RNA, 18 nt, Human
uccccaaacacagucccc

SEQ ID NO: 1387494 - RNA, 22 nt, Human
ucccugggaaggccuaauacuu

SEQ ID NO: 1387495 - RNA, 27 nt, Human
ucccugggaaggccuaauacuuagccc

SEQ ID NO: 1387496 - RNA, 23 nt, Human
uccucagccccuccucccauccc

SEQ ID NO: 1387497 - RNA, 24 nt, Human
uccuugccccugggugccacuggc

SEQ ID NO: 1387498 - RNA, 22 nt, Human
ucucucggggagaaccagucuc

SEQ ID NO: 1387499 - RNA, 19 nt, Human
ucuggauuaagggucaggg

SEQ ID NO: 1387500 - RNA, 22 nt, Human
ugcccacguggccccacacgug

SEQ ID NO: 1387501 - RNA, 18 nt, Human
ugcccugggccugcaaca

SEQ ID NO: 1387502 - RNA, 23 nt, Human
ugcgaagcccggaaccacagggc

SEQ ID NO: 1387503 - RNA, 20 nt, Human
uggcaaggguggggguuggc

SEQ ID NO: 1387504 - RNA, 18 nt, Human
ugggaggugacacugagc

SEQ ID NO: 1387505 - RNA, 21 nt, Human
ugggaugcuuggcacgccccc

SEQ ID NO: 1387506 - RNA, 21 nt, Human
uucaggagaaagauaugaaaa

SEQ ID NO: 1387507 - RNA, 20 nt, Human
agaaaagccaaauacucuuc

SEQ ID NO: 1387508 - RNA, 20 nt, Human
agccaaauacucuuccacua

SEQ ID NO: 1387509 - RNA, 19 nt, Human
aucaucuucaucaucagaa

SEQ ID NO: 1387510 - RNA, 18 nt, Human
aucuacaucgccuuccuu

SEQ ID NO: 1387511 - RNA, 22 nt, Human
augcacgcauauuugaaauccc

SEQ ID NO: 1387512 - RNA, 23 nt, Human
caacgugugaagcagcggugccg

SEQ ID NO: 1387513 - RNA, 20 nt, Human
caacucaaagucauuuguuu

SEQ ID NO: 1387514 - RNA, 21 nt, Human
caagauuaccaagaaaagcca

SEQ ID NO: 1387515 - RNA, 21 nt, Human
caugacagaagaacggaauuc

SEQ ID NO: 1387516 - RNA, 19 nt, Human
cgaagcggccgcaucuccc

SEQ ID NO: 1387517 - RNA, 25 nt, Human
cuucuauucaaccaaggcaaucuca

SEQ ID NO: 1387518 - RNA, 19 nt, Human
cuuuugucaaguacaugac

SEQ ID NO: 1387519 - RNA, 21 nt, Human
gacacggucugaggaaaacag

SEQ ID NO: 1387520 - RNA, 21 nt, Human
gaggcacaaaaugggaagcaa

SEQ ID NO: 1387521 - RNA, 19 nt, Human
uaccaagaaaagccaaaua

SEQ ID NO: 1387522 - RNA, 20 nt, Human
uaccaagaaaagccaaauac

SEQ ID NO: 1387523 - RNA, 21 nt, Human
ucaaagucauuuguuucaccc

SEQ ID NO: 1387524 - RNA, 24 nt, Human
ucacaguuccaccaaaccgaacag

SEQ ID NO: 1387525 - RNA, 22 nt, Human
ucccgacaaacaacgugugaag

SEQ ID NO: 1387526 - RNA, 20 nt, Human
uccucgacgcgcccagcguc

SEQ ID NO: 1387527 - RNA, 18 nt, Human
ucuaacagcugguucuuc

SEQ ID NO: 1387528 - RNA, 21 nt, Human
ucucuaaugcacgcauauuug

SEQ ID NO: 1387529 - RNA, 26 nt, Human
ucugugauaugugucaaaauuugcag

SEQ ID NO: 1387530 - RNA, 22 nt, Human
ucuuuugucaaguacaugacag

SEQ ID NO: 1387531 - RNA, 20 nt, Human
ugacagaagaacggaauucu

SEQ ID NO: 1387532 - RNA, 19 nt, Human
ugauaaguugcucaaaguc

SEQ ID NO: 1387533 - RNA, 19 nt, Human
ugcagaggacgaagcggcc

SEQ ID NO: 1387534 - RNA, 23 nt, Human
uguuucacccuuuuuguacuuca

SEQ ID NO: 1387535 - RNA, 22 nt, Human
uucaaccaaggcaaucucaaua

SEQ ID NO: 1387536 - RNA, 26 nt, Human
aaacuugcgaccuaggaagcccuugg

SEQ ID NO: 1387537 - RNA, 23 nt, Human
aaagcccuucccaaacuugcgac

SEQ ID NO: 1387538 - RNA, 22 nt, Human
aacuugcgaccuaggaagcccu

SEQ ID NO: 1387539 - RNA, 21 nt, Human
aagcugcccagucaaguugcu

SEQ ID NO: 1387540 - RNA, 24 nt, Human
agauguaaaagcccuucccaaacu

SEQ ID NO: 1387541 - RNA, 24 nt, Human
aggaaagccaaagcuuguggucag

SEQ ID NO: 1387542 - RNA, 20 nt, Human
agggcuuugcgcagaucuuc

SEQ ID NO: 1387543 - RNA, 24 nt, Human
aucugugucagcaguucuggguuu

SEQ ID NO: 1387544 - RNA, 23 nt, Human
aucuuccgccauauguuucgcua

SEQ ID NO: 1387545 - RNA, 24 nt, Human
caccaagaauagccagacgcuuaa

SEQ ID NO: 1387546 - RNA, 26 nt, Human
caccaagaauagccagacgcuuaaca

SEQ ID NO: 1387547 - RNA, 22 nt, Human
caggucaacuccuuccuggagg

SEQ ID NO: 1387548 - RNA, 19 nt, Human
caguucuggguuuccaccu

SEQ ID NO: 1387549 - RNA, 23 nt, Human
cauccacgccaacuucauccacc

SEQ ID NO: 1387550 - RNA, 22 nt, Human
ccaaacuugcgaccuaggaagc

SEQ ID NO: 1387551 - RNA, 21 nt, Human
ccuccugauagauguaaaagc

SEQ ID NO: 1387552 - RNA, 22 nt, Human
ccuccugauagauguaaaagcc

SEQ ID NO: 1387553 - RNA, 24 nt, Human
cugauagauguaaaagcccuuccc

SEQ ID NO: 1387554 - RNA, 22 nt, Human
gauagauguaaaagcccuuccc

SEQ ID NO: 1387555 - RNA, 20 nt, Human
ggcaucuuuaaguauagucu

SEQ ID NO: 1387556 - RNA, 19 nt, Human
uagccuagugaguguggca

SEQ ID NO: 1387557 - RNA, 25 nt, Human
uauagucuuuagccucuuauccaca

SEQ ID NO: 1387558 - RNA, 19 nt, Human
uccaaaccgcuccccaagg

SEQ ID NO: 1387559 - RNA, 21 nt, Human
ugccugcucccuucagcccuu

SEQ ID NO: 1387560 - RNA, 19 nt, Human
uggcggcacccacaggaaa

SEQ ID NO: 1387561 - RNA, 21 nt, Human
uggguuuccaccuccaaaccg

SEQ ID NO: 1387562 - RNA, 22 nt, Human
uugggugaugccugcucccuuc

SEQ ID NO: 1387563 - RNA, 19 nt, Human
aaaaguucucccacauuac

SEQ ID NO: 1387564 - RNA, 20 nt, Human
aaaguucucccacauuacac

SEQ ID NO: 1387565 - RNA, 18 nt, Human
acaaagucaauuuuacgg

SEQ ID NO: 1387566 - RNA, 21 nt, Human
agacuuugccaaacuccucca

SEQ ID NO: 1387567 - RNA, 20 nt, Human
agcgaugagagaacccgaaa

SEQ ID NO: 1387568 - RNA, 18 nt, Human
ccacauuacacuaaagca

SEQ ID NO: 1387569 - RNA, 19 nt, Human
cgacggccuagaggagagg

SEQ ID NO: 1387570 - RNA, 22 nt, Human
cggccuagaggagaggagccaa

SEQ ID NO: 1387571 - RNA, 25 nt, Human
cugacuaggucaaaaauaguuacgc

SEQ ID NO: 1387572 - RNA, 22 nt, Human
gaaacgcuguuccuccuuuucc

SEQ ID NO: 1387573 - RNA, 22 nt, Human
gaugagagaacccgaaagcgac

SEQ ID NO: 1387574 - RNA, 19 nt, Human
gcuagcgcccgggacuugg

SEQ ID NO: 1387575 - RNA, 18 nt, Human
uaacuccuucaaaugcac

SEQ ID NO: 1387576 - RNA, 24 nt, Human
uagaggagaggagccaagaggcgg

SEQ ID NO: 1387577 - RNA, 20 nt, Human
ucccacauuacacuaaagca

SEQ ID NO: 1387578 - RNA, 20 nt, Human
uccuccuuuuccauggagcc

SEQ ID NO: 1387579 - RNA, 20 nt, Human
ucucuuuuaauuaacuccuu

SEQ ID NO: 1387580 - RNA, 20 nt, Human
ugaaaacuuuuucaauugca

SEQ ID NO: 1387581 - RNA, 21 nt, Human
ugagagaacccgaaagcgacg

SEQ ID NO: 1387582 - RNA, 20 nt, Human
ugccaaacuccuccaaguuc

SEQ ID NO: 1387583 - RNA, 18 nt, Human
acaagagggcuguacaaa

SEQ ID NO: 1387584 - RNA, 26 nt, Human
aggcagguaaacccaaguuugccaaa

SEQ ID NO: 1387585 - RNA, 20 nt, Human
caccauggacacgaguggag

SEQ ID NO: 1387586 - RNA, 21 nt, Human
cgaccagcugcugcugcugca

SEQ ID NO: 1387587 - RNA, 22 nt, Human
cgcaguggacaucugcuaaugc

SEQ ID NO: 1387588 - RNA, 21 nt, Human
cggugaggaggaggaggacac

SEQ ID NO: 1387589 - RNA, 18 nt, Human
gagagagacuugucuaca

SEQ ID NO: 1387590 - RNA, 21 nt, Human
gcaguggacaucugcuaaugc

SEQ ID NO: 1387591 - RNA, 22 nt, Human
gccaaacaaaggcaguaacccc

SEQ ID NO: 1387592 - RNA, 21 nt, Human
gccuuugaguugcaggucagg

SEQ ID NO: 1387593 - RNA, 21 nt, Human
gcgaccagcugcugcugcugc

SEQ ID NO: 1387594 - RNA, 22 nt, Human
ggaaguucuguugguaugagag

SEQ ID NO: 1387595 - RNA, 18 nt, Human
ucuacaggcagguaaacc

SEQ ID NO: 1387596 - RNA, 18 nt, Human
ugagaagagcgaggugag

SEQ ID NO: 1387597 - RNA, 21 nt, Human
ugaggaggaggaggacaccau

SEQ ID NO: 1387598 - RNA, 22 nt, Human
ugaggaggaggaggacaccaug

SEQ ID NO: 1387599 - RNA, 24 nt, Human
ugaguggggaugcuauacaagagg

SEQ ID NO: 1387600 - RNA, 19 nt, Human
ugcugcacggugaggagga

SEQ ID NO: 1387601 - RNA, 19 nt, Human
uggaugggacaacgcagug

SEQ ID NO: 1387602 - RNA, 21 nt, Human
ugguucuggaaguaccggaag

SEQ ID NO: 1387603 - RNA, 18 nt, Human
aacacaacuccucuugac

SEQ ID NO: 1387604 - RNA, 19 nt, Human
aagaacaacaacagacugg

SEQ ID NO: 1387605 - RNA, 21 nt, Human
acuggucuguguaccccagac

SEQ ID NO: 1387606 - RNA, 18 nt, Human
agacaggaaaagagaucu

SEQ ID NO: 1387607 - RNA, 21 nt, Human
agacuaggggucacugcaaac

SEQ ID NO: 1387608 - RNA, 27 nt, Human
aggaggagcccauuaagaacaacaacc

SEQ ID NO: 1387609 - RNA, 23 nt, Human
caagacaggaaaagagaucuuga

SEQ ID NO: 1387610 - RNA, 25 nt, Human
caaggaggagcccauuaagaacaac

SEQ ID NO: 1387611 - RNA, 22 nt, Human
caccuccaagacaggaaaagag

SEQ ID NO: 1387612 - RNA, 19 nt, Human
cacugucaauaaggaacac

SEQ ID NO: 1387613 - RNA, 18 nt, Human
cccauuaagaacaacaac

SEQ ID NO: 1387614 - RNA, 21 nt, Human
cccgcggcuggucgcccugga

SEQ ID NO: 1387615 - RNA, 20 nt, Human
ccucuugacacaaacacacc

SEQ ID NO: 1387616 - RNA, 24 nt, Human
cgaggauccgccgcagaagcgcca

SEQ ID NO: 1387617 - RNA, 19 nt, Human
cuccaagacaggaaaagag

SEQ ID NO: 1387618 - RNA, 22 nt, Human
cuggcgagaaugacggggccuu

SEQ ID NO: 1387619 - RNA, 20 nt, Human
gagcccauuaagaacaacaa

SEQ ID NO: 1387620 - RNA, 19 nt, Human
gcccgcggcuggucgcccu

SEQ ID NO: 1387621 - RNA, 21 nt, Human
gcccuggacgccgugggcccc

SEQ ID NO: 1387622 - RNA, 21 nt, Human
guggaggcccgcccaccuaca

SEQ ID NO: 1387623 - RNA, 21 nt, Human
uaagaacaacaacagacuggc

SEQ ID NO: 1387624 - RNA, 24 nt, Human
uaccccagacuaggggucacugca

SEQ ID NO: 1387625 - RNA, 19 nt, Human
uccaagacaggaaaagaga

SEQ ID NO: 1387626 - RNA, 27 nt, Human
uccucuugacacaaacacacacacaau

SEQ ID NO: 1387627 - RNA, 19 nt, Human
ugacguggaggcccgccca

SEQ ID NO: 1387628 - RNA, 24 nt, Human
uuaagaacaacaacagacuggcga

SEQ ID NO: 1387629 - RNA, 23 nt, Human
uucaaggaggagcccauuaagaa

SEQ ID NO: 1387630 - RNA, 26 nt, Human
uugaacacugucaauaaggaacacug

SEQ ID NO: 1387631 - RNA, 24 nt, Human
uugacacaaacacacacacauuuc

SEQ ID NO: 1387632 - RNA, 20 nt, Human
uuucucagauaugacuuuuc

SEQ ID NO: 1387633 - RNA, 19 nt, Human
aaaaucccuccaugcuaac

SEQ ID NO: 1387634 - RNA, 19 nt, Human
acuccacuacccagccaau

SEQ ID NO: 1387635 - RNA, 24 nt, Human
aucaucccucucuccuacaaauuc

SEQ ID NO: 1387636 - RNA, 23 nt, Human
caacacuccacuacccagccaau

SEQ ID NO: 1387637 - RNA, 22 nt, Human
cacuacccagccaaugguagcc

SEQ ID NO: 1387638 - RNA, 20 nt, Human
cacuccacuacccagccaau

SEQ ID NO: 1387639 - RNA, 31 nt, Human; identical to SEQ ID NO: 1309325

SEQ ID NO: 1387640 - RNA, 19 nt, Human
ccaaugguagcccuaaaau

SEQ ID NO: 1387641 - RNA, 19 nt, Human
cgacuaacuccaggcugcc

SEQ ID NO: 1387642 - RNA, 24 nt, Human
cuaaaaucccuccaugcuaacugg

SEQ ID NO: 1387643 - RNA, 25 nt, Human
cuguauauacaccucucgcgauccc

SEQ ID NO: 1387644 - RNA, 21 nt, Human
gcccuaaaaucccuccaugcu

SEQ ID NO: 1387645 - RNA, 21 nt, Human
ggacgagacaaucacgccccu

SEQ ID NO: 1387646 - RNA, 21 nt, Human
uaaaaucccuccaugcuaacu

SEQ ID NO: 1387647 - RNA, 18 nt, Human
ucaaucaucccucucucc

SEQ ID NO: 1387648 - RNA, 19 nt, Human
ucacauacuucucccagca

SEQ ID NO: 1387649 - RNA, 24 nt, Human
ucuccuacaaauuccucugcuaca

SEQ ID NO: 1387650 - RNA, 24 nt, Human
aagagcccagggagguggcugggg

SEQ ID NO: 1387651 - RNA, 26 nt, Human
aaggggaguaaaaaagagcccaggga

SEQ ID NO: 1387652 - RNA, 21 nt, Human
agagaagccagccagaguggg

SEQ ID NO: 1387653 - RNA, 19 nt, Human
agagaggagagagguuugg

SEQ ID NO: 1387654 - RNA, 20 nt, Human
agaugggcgauguggugggg

SEQ ID NO: 1387655 - RNA, 18 nt, Human
aggaauggauagaggggu

SEQ ID NO: 1387656 - RNA, 25 nt, Human
aggagauaguggagggggugggggc

SEQ ID NO: 1387657 - RNA, 22 nt, Human
agggagguggcuggggcgggag

SEQ ID NO: 1387658 - RNA, 20 nt, Human
agggggugggggccaaggug

SEQ ID NO: 1387659 - RNA, 18 nt, Human
agguggcuggggcgggag

SEQ ID NO: 1387660 - RNA, 25 nt, Human
aucagccggggggcugaaggggagu

SEQ ID NO: 1387661 - RNA, 27 nt, Human
caagguggggccacaggaagagagggc

SEQ ID NO: 1387662 - RNA, 19 nt, Human
cagaaccagagauggcauc

SEQ ID NO: 1387663 - RNA, 19 nt, Human
cagaauacaaaauuggggg

SEQ ID NO: 1387664 - RNA, 25 nt, Human
cagccagagugggggcggcaggaga

SEQ ID NO: 1387665 - RNA, 19 nt, Human
ccacaggaagagagggcuc

SEQ ID NO: 1387666 - RNA, 21 nt, Human
cggcaggagauaguggagggg

SEQ ID NO: 1387667 - RNA, 24 nt, Human
cguccguuggucccaccgcacaga

SEQ ID NO: 1387668 - RNA, 19 nt, Human
gaggaauggauagaggggu

SEQ ID NO: 1387669 - RNA, 20 nt, Human
gagggggugggggccaaggu

SEQ ID NO: 1387670 - RNA, 20 nt, Human
gcaggagauaguggaggggg

SEQ ID NO: 1387671 - RNA, 18 nt, Human
gcgguccugggccugggg

SEQ ID NO: 1387672 - RNA, 21 nt, Human
gcgguccugggccugggggac

SEQ ID NO: 1387673 - RNA, 21 nt, Human
ggagagaagccagccagagug

SEQ ID NO: 1387674 - RNA, 20 nt, Human
ggagauaguggagggggugg

SEQ ID NO: 1387675 - RNA, 24 nt, Human
ggagggggugggggccaagguggg

SEQ ID NO: 1387676 - RNA, 18 nt, Human
ggcaggagauaguggagg

SEQ ID NO: 1387677 - RNA, 24 nt, Human
ggcaggagauaguggagggggugg

SEQ ID NO: 1387678 - RNA, 23 nt, Human
ggcaucagccggggggcugaagg

SEQ ID NO: 1387679 - RNA, 22 nt, Human
ggcggggcggggaccucggggc

SEQ ID NO: 1387680 - RNA, 26 nt, Human
ggcuugggcugggagccucugcaaca

SEQ ID NO: 1387681 - RNA, 18 nt, Human
gggccugggggacgggga

SEQ ID NO: 1387682 - RNA, 19 nt, Human
ggggaagagaugggcgaug

SEQ ID NO: 1387683 - RNA, 22 nt, Human
ggggugggggccaagguggggc

SEQ ID NO: 1387684 - RNA, 25 nt, Human
uaaaaaagagcccagggagguggcu

SEQ ID NO: 1387685 - RNA, 22 nt, Human
uaguggagggggugggggccaa

SEQ ID NO: 1387686 - RNA, 22 nt, Human
ugaggagagggagagaaacuga

SEQ ID NO: 1387687 - RNA, 18 nt, Human
uggagggggugggggcca

SEQ ID NO: 1387688 - RNA, 21 nt, Human
uggagggggugggggccaagg

SEQ ID NO: 1387689 - RNA, 24 nt, Human
uggagggggugggggccaaggugg

SEQ ID NO: 1387690 - RNA, 20 nt, Human
uggggcgggaggaauggaua

SEQ ID NO: 1387691 - RNA, 20 nt, Human
uggggggacugacaggggcg

SEQ ID NO: 1387692 - RNA, 23 nt, Human
acccaggccacaggugguggagc

SEQ ID NO: 1387693 - RNA, 23 nt, Human
agagaagccaccccaacaguggg

SEQ ID NO: 1387694 - RNA, 21 nt, Human
aggccccaggccacccuccag

SEQ ID NO: 1387695 - RNA, 24 nt, Human
agggccacagguggcagcggcggg

SEQ ID NO: 1387696 - RNA, 21 nt, Human
agguggcagcggcgggcaggc

SEQ ID NO: 1387697 - RNA, 22 nt, Human
cacaggccccaggccacccucc

SEQ ID NO: 1387698 - RNA, 23 nt, Human
cacaguucacuauccacaggccc

SEQ ID NO: 1387699 - RNA, 19 nt, Human
cagagcugacucccaggcu

SEQ ID NO: 1387700 - RNA, 21 nt, Human
cagcggcgggcaggcuggggc

SEQ ID NO: 1387701 - RNA, 22 nt, Human
cagcggcgggcaggcuggggcc

SEQ ID NO: 1387702 - RNA, 20 nt, Human
ccacaggccccaggccaccc

SEQ ID NO: 1387703 - RNA, 18 nt, Human
cccaggccacccuccaga

SEQ ID NO: 1387704 - RNA, 18 nt, Human
cccuccagagcugacucc

SEQ ID NO: 1387705 - RNA, 19 nt, Human
ccuccagagcugacuccca

SEQ ID NO: 1387706 - RNA, 18 nt, Human
ccucggguuccucaucau

SEQ ID NO: 1387707 - RNA, 22 nt, Human
cucgggggcagguggggugcuc

SEQ ID NO: 1387708 - RNA, 22 nt, Human
cugacucccaggcuacuguccc

SEQ ID NO: 1387709 - RNA, 23 nt, Human
cuggggccggccagcggggucgc

SEQ ID NO: 1387710 - RNA, 19 nt, Human
gaagccaccccaacagugg

SEQ ID NO: 1387711 - RNA, 24 nt, Human
gagaagccaccccaacagugggcc

SEQ ID NO: 1387712 - RNA, 24 nt, Human
gcagguggggugcuccgcagcccu

SEQ ID NO: 1387713 - RNA, 18 nt, Human
gcugggucucgggggcag

SEQ ID NO: 1387714 - RNA, 23 nt, Human
ggagagaagccaccccaacagug

SEQ ID NO: 1387715 - RNA, 19 nt, Human
ggcuaugggaggaggaggg

SEQ ID NO: 1387716 - RNA, 19 nt, Human
ggcugggucucgggggcag

SEQ ID NO: 1387717 - RNA, 24 nt, Human
gggcagcguggggcugggucucgg

SEQ ID NO: 1387718 - RNA, 19 nt, Human
ucgggggcagguggggugc

SEQ ID NO: 1387719 - RNA, 24 nt, Human
ucucgggggcagguggggugcucc

SEQ ID NO: 1387720 - RNA, 21 nt, Human
ugagugccagguggcacaggg

SEQ ID NO: 1387721 - RNA, 18 nt, Human
ugggcagcguggggcugg

SEQ ID NO: 1387722 - RNA, 19 nt, Human
uuacuccaguugccugagu

SEQ ID NO: 1387723 - RNA, 24 nt, Human
agaagaggcggcuugcagggcugg

SEQ ID NO: 1387724 - RNA, 24 nt, Human
agagagcucuguccuucucccuuc

SEQ ID NO: 1387725 - RNA, 18 nt, Human
caccuguccacaccuguc

SEQ ID NO: 1387726 - RNA, 24 nt, Human
ccugucacugggccuuucccuggg

SEQ ID NO: 1387727 - RNA, 23 nt, Human
cgagaagaggcggcuugcagggc

SEQ ID NO: 1387728 - RNA, 22 nt, Human
gcagggcuggcaccuguccaca

SEQ ID NO: 1387729 - RNA, 22 nt, Human
gcuggcaccuguccacaccugu

SEQ ID NO: 1387730 - RNA, 24 nt, Human
uaugugcagggccugugcaggagc

SEQ ID NO: 1387731 - RNA, 21 nt, Human
uccuucucccuucuaccgaga

SEQ ID NO: 1387732 - RNA, 21 nt, Human
ugagugggagcagaugcccuc

SEQ ID NO: 1387733 - RNA, 20 nt, Human
uugcagggcuggcaccuguc

SEQ ID NO: 1387734 - RNA, 19 nt, Human
aagagcgaaguguggcaca

SEQ ID NO: 1387735 - RNA, 23 nt, Human
cacgcauccguggaguccagagc

SEQ ID NO: 1387736 - RNA, 26 nt, Human
cauagcccacauuccucugcccacgc

SEQ ID NO: 1387737 - RNA, 19 nt, Human
ggaguccagagcccagaaa

SEQ ID NO: 1387738 - RNA, 20 nt, Human
ggcugaucagcucaugcaga

SEQ ID NO: 1387739 - RNA, 21 nt, Human
guccagagcccagaaagccuc

SEQ ID NO: 1387740 - RNA, 20 nt, Human
uauuaugacuacauagccca

SEQ ID NO: 1387741 - RNA, 23 nt, Human
ucaagagcgaaguguggcacaga

SEQ ID NO: 1387742 - RNA, 21 nt, Human
agaguucugggaccucucagg

SEQ ID NO: 1387743 - RNA, 19 nt, Human
cagaguucugggaccucuc

SEQ ID NO: 1387744 - RNA, 22 nt, Human
cucucagggaaccaagcaguag

SEQ ID NO: 1387745 - RNA, 18 nt, Human
uaagaaaagagaaaaaua

SEQ ID NO: 1387746 - RNA, 24 nt, Human
ugauagaucugcaagaaaaaucuc

SEQ ID NO: 1387747 - RNA, 25 nt, Human
ugccuggaagagaacuuuggauuuc

SEQ ID NO: 1387748 - RNA, 21 nt, Human
uggaauuauuaaaaaaugaaa

SEQ ID NO: 1387749 - RNA, 23 nt, Human
aaaaagaauccuccaaaagugaa

SEQ ID NO: 1387750 - RNA, 21 nt, Human
aaaacucaaccagccagccuc

SEQ ID NO: 1387751 - RNA, 21 nt, Human
aaaccagcagugcuccaaggc

SEQ ID NO: 1387752 - RNA, 21 nt, Human
agaaaauaacaaaacucaacc

SEQ ID NO: 1387753 - RNA, 23 nt, Human
agaaaauaacaaaacucaaccag

SEQ ID NO: 1387754 - RNA, 24 nt, Human
agacagauaggaauuaggaucagg

SEQ ID NO: 1387755 - RNA, 23 nt, Human
agacagcuggguucagugaagug

SEQ ID NO: 1387756 - RNA, 22 nt, Human
agagccugcgagaaaaacaggc

SEQ ID NO: 1387757 - RNA, 18 nt, Human
agcacugaagagcaagau

SEQ ID NO: 1387758 - RNA, 19 nt, Human
agcccccauccagggacag

SEQ ID NO: 1387759 - RNA, 19 nt, Human
aggaacacagaucaguaca

SEQ ID NO: 1387760 - RNA, 23 nt, Human
aggacagaauuauagccccaggu

SEQ ID NO: 1387761 - RNA, 24 nt, Human
auagagccugcgagaaaaacaggc

SEQ ID NO: 1387762 - RNA, 20 nt, Human
aucaaagccucaaccuuugc

SEQ ID NO: 1387763 - RNA, 21 nt, Human
caaaaacacuuucccuuggga

SEQ ID NO: 1387764 - RNA, 20 nt, Human
caaaaagaauccuccaaaag

SEQ ID NO: 1387765 - RNA, 21 nt, Human
cacagccaaaguccaucaucc

SEQ ID NO: 1387766 - RNA, 21 nt, Human
cagagcucaaaugcagaccgu

SEQ ID NO: 1387767 - RNA, 24 nt, Human
cagcacugaagagcaagaucuuca

SEQ ID NO: 1387768 - RNA, 20 nt, Human
cagcagugcuccaaggcaga

SEQ ID NO: 1387769 - RNA, 25 nt, Human
cauuauauacaaaaacacuuucccu

SEQ ID NO: 1387770 - RNA, 24 nt, Human
ccaauaauuaagaaaaaaaccauc

SEQ ID NO: 1387771 - RNA, 20 nt, Human
ccccacauaugcuuccaacc

SEQ ID NO: 1387772 - RNA, 19 nt, Human
ccuggcucacagccaaagu

SEQ ID NO: 1387773 - RNA, 23 nt, Human
cgagaaaaacaggcaauuuggga

SEQ ID NO: 1387774 - RNA, 20 nt, Human
cgccagagacucacucaggg

SEQ ID NO: 1387775 - RNA, 26 nt, Human
cucacagccaaaguccaucauccauu

SEQ ID NO: 1387776 - RNA, 19 nt, Human
cucagggacagaaaauggc

SEQ ID NO: 1387777 - RNA, 21 nt, Human
cuccaaaagugaaaaaauaca

SEQ ID NO: 1387778 - RNA, 19 nt, Human
cuccccacauaugcuucca

SEQ ID NO: 1387779 - RNA, 20 nt, Human
gaaaaaaaccaucaaagccu

SEQ ID NO: 1387780 - RNA, 20 nt, Human
gaaaauaacaaaacucaacc

SEQ ID NO: 1387781 - RNA, 23 nt, Human
gaacggaauagagccugcgagaa

SEQ ID NO: 1387782 - RNA, 22 nt, Human
gacaagaaccauccuaggccug

SEQ ID NO: 1387783 - RNA, 20 nt, Human
gacagaauuauagccccagg

SEQ ID NO: 1387784 - RNA, 25 nt, Human
gacgccagagacucacucagggaca

SEQ ID NO: 1387785 - RNA, 24 nt, Human
gauaggaauuaggaucaggaacac

SEQ ID NO: 1387786 - RNA, 20 nt, Human
gccagaacaaaaccuuuggc

SEQ ID NO: 1387787 - RNA, 22 nt, Human
ggaauagagccugcgagaaaaa

SEQ ID NO: 1387788 - RNA, 25 nt, Human
uaagaaaaaaaccaucaaagccuca

SEQ ID NO: 1387789 - RNA, 22 nt, Human
uaggaauuaggaucaggaacac

SEQ ID NO: 1387790 - RNA, 22 nt, Human
uauaaaaccagcagugcuccaa

SEQ ID NO: 1387791 - RNA, 19 nt, Human
uauacagaaaauaacaaaa

SEQ ID NO: 1387792 - RNA, 22 nt, Human
uauagcaccauuggaaaacaaa

SEQ ID NO: 1387793 - RNA, 23 nt, Human
uauagccccaggugaagacuagg

SEQ ID NO: 1387794 - RNA, 22 nt, Human
uaucucaaccuuucuauacaga

SEQ ID NO: 1387795 - RNA, 22 nt, Human
ucaaagccucaaccuuugcuua

SEQ ID NO: 1387796 - RNA, 27 nt, Human
ucaaccuuucuauacagaaaauaacaa

SEQ ID NO: 1387797 - RNA, 21 nt, Human
ucagccaauaauuaagaaaaa

SEQ ID NO: 1387798 - RNA, 20 nt, Human
ucagggacagaaaauggcag

SEQ ID NO: 1387799 - RNA, 22 nt, Human
ucagugaaguguuugaaaacag

SEQ ID NO: 1387800 - RNA, 19 nt, Human
uggaaaacaaaggccuaca

SEQ ID NO: 1387801 - RNA, 19 nt, Human
uggauauaggacaagaacc

SEQ ID NO: 1387802 - RNA, 22 nt, Human
uggcuacuuucaaaccagagcu

SEQ ID NO: 1387803 - RNA, 23 nt, Human
uuagcaucuuuauuugagaaguc

SEQ ID NO: 1387804 - RNA, 21 nt, Human
uucagaguucuuuuuccagga

SEQ ID NO: 1387805 - RNA, 23 nt, Human
uugggaggagggcugugcccccu

SEQ ID NO: 1387806 - RNA, 19 nt, Human
uuucagaguucuuuuucca

SEQ ID NO: 1387807 - RNA, 19 nt, Human
uuuguagcccccauccagg

SEQ ID NO: 1387808 - RNA, 19 nt, Human
aacaagagaauucugggga

SEQ ID NO: 1387809 - RNA, 18 nt, Human
aagaccucuagagaauca

SEQ ID NO: 1387810 - RNA, 26 nt, Human
aagcaauucucgugccucagccuccu

SEQ ID NO: 1387811 - RNA, 22 nt, Human
aagcagucaaagagaggguggc

SEQ ID NO: 1387812 - RNA, 23 nt, Human
aaggacuccauguguccaguggg

SEQ ID NO: 1387813 - RNA, 27 nt, Human
aaggacuccauguguccaguggggagc

SEQ ID NO: 1387814 - RNA, 25 nt, Human
aaggcugaucucagcccccuccaca

SEQ ID NO: 1387815 - RNA, 22 nt, Human
aagugcccacgccuggccucac

SEQ ID NO: 1387816 - RNA, 18 nt, Human
aagugcugggguuacagg

SEQ ID NO: 1387817 - RNA, 19 nt, Human
aagugcugggguuacaggc

SEQ ID NO: 1387818 - RNA, 23 nt, Human
aagugcugggguuacaggccuga

SEQ ID NO: 1387819 - RNA, 26 nt, Human
aagugcugggguuacaggccugagcu

SEQ ID NO: 1387820 - RNA, 20 nt, Human
aaugggauuuuccaaggccc

SEQ ID NO: 1387821 - RNA, 18 nt, Human
acaagagaauucugggga

SEQ ID NO: 1387822 - RNA, 24 nt, Human
acacaacccagagacgagggaacc

SEQ ID NO: 1387823 - RNA, 20 nt, Human
acccaugaugaccaaaucuc

SEQ ID NO: 1387824 - RNA, 21 nt, Human
accccgcugcccaggucccca

SEQ ID NO: 1387825 - RNA, 18 nt, Human
acccugugcucgucucag

SEQ ID NO: 1387826 - RNA, 18 nt, Human
acgggguuucgccauguu

SEQ ID NO: 1387827 - RNA, 23 nt, Human
acgggguuucgccauguuggcca

SEQ ID NO: 1387828 - RNA, 24 nt, Human
acgggguuucgccauguuggccag

SEQ ID NO: 1387829 - RNA, 18 nt, Human
acugaggggcaucgcagg

SEQ ID NO: 1387830 - RNA, 24 nt, Human
agcaauucucgugccucagccucc

SEQ ID NO: 1387831 - RNA, 18 nt, Human
agccccgcugaaugggau

SEQ ID NO: 1387832 - RNA, 20 nt, Human
aggaccacccccuccaccuc

SEQ ID NO: 1387833 - RNA, 20 nt, Human
aggagcuuccggagcugggc

SEQ ID NO: 1387834 - RNA, 20 nt, Human
aggcagcccucuagagcucc

SEQ ID NO: 1387835 - RNA, 20 nt, Human
aggcagggaggcugcaaagg

SEQ ID NO: 1387836 - RNA, 20 nt, Human
aggcagggccuugaagccuc

SEQ ID NO: 1387837 - RNA, 21 nt, Human
aggccuccccaccccacuccc

SEQ ID NO: 1387838 - RNA, 20 nt, Human
aggcucuucaccccacuccc

SEQ ID NO: 1387839 - RNA, 21 nt, Human
agggcuaagagcauggcccag

SEQ ID NO: 1387840 - RNA, 21 nt, Human
aggguaaagggcccacgaugg

SEQ ID NO: 1387841 - RNA, 24 nt, Human
aggugauccgcccaccucagccuc

SEQ ID NO: 1387842 - RNA, 23 nt, Human
agguggggucagaggccccaggg

SEQ ID NO: 1387843 - RNA, 24 nt, Human
agguggggucagaggccccagggc

SEQ ID NO: 1387844 - RNA, 18 nt, Human
aguagcugggauuacagg

SEQ ID NO: 1387845 - RNA, 24 nt, Human
agucaucaccucucugacucuaga

SEQ ID NO: 1387846 - RNA, 19 nt, Human
agucugaguuggugagacc

SEQ ID NO: 1387847 - RNA, 21 nt, Human
agugcucaaaguccccuaccu

SEQ ID NO: 1387848 - RNA, 24 nt, Human
agugcugggguuacaggccugagc

SEQ ID NO: 1387849 - RNA, 20 nt, Human
aguucaguggugcgaucuug

SEQ ID NO: 1387850 - RNA, 21 nt, Human
aucagugaccgcaccugaagu

SEQ ID NO: 1387851 - RNA, 18 nt, Human
aucauauuuucacuaagc

SEQ ID NO: 1387852 - RNA, 22 nt, Human
augaaggaaaaggccaucuaca

SEQ ID NO: 1387853 - RNA, 24 nt, Human
auuuuugcauguuuaguagagacg

SEQ ID NO: 1387854 - RNA, 18 nt, Human
caaagaggcuccaaggac

SEQ ID NO: 1387855 - RNA, 23 nt, Human
caaagcagcagugcucaaagucc

SEQ ID NO: 1387856 - RNA, 24 nt, Human
caaccacuccugauucccuguccc

SEQ ID NO: 1387857 - RNA, 18 nt, Human
caacccagagacgacugg

SEQ ID NO: 1387858 - RNA, 23 nt, Human
caagggacccccuguguccagug

SEQ ID NO: 1387859 - RNA, 18 nt, Human
caaggucagcacaaaacc

SEQ ID NO: 1387860 - RNA, 20 nt, Human
cacaacccagagacgacugg

SEQ ID NO: 1387861 - RNA, 19 nt, Human
cacaaugacccucagugac

SEQ ID NO: 1387862 - RNA, 20 nt, Human
cacagcaagucucucaucau

SEQ ID NO: 1387863 - RNA, 19 nt, Human
cacagguggggucagaggc

SEQ ID NO: 1387864 - RNA, 18 nt, Human
caccaaggaaaaaacaag

SEQ ID NO: 1387865 - RNA, 18 nt, Human
caccaaggaaaaaacaag

SEQ ID NO: 1387866 - RNA, 23 nt, Human
caccaaggaaaaaacaagagaau

SEQ ID NO: 1387867 - RNA, 24 nt, Human
caccccacucccagacgaaggacu

SEQ ID NO: 1387868 - RNA, 26 nt, Human
cacccccuccaccccaucagggucca

SEQ ID NO: 1387869 - RNA, 24 nt, Human
caccucagccucccgaagugcugg

SEQ ID NO: 1387870 - RNA, 19 nt, Human
caccuggaggcaguugggg

SEQ ID NO: 1387871 - RNA, 24 nt, Human
caccuggcgagugcugagggaugc

SEQ ID NO: 1387872 - RNA, 24 nt, Human
cagaaccaagguccagcagccauc

SEQ ID NO: 1387873 - RNA, 20 nt, Human
cagaagugcccacgccuggc

SEQ ID NO: 1387874 - RNA, 19 nt, Human
cagacucugccccaucagg

SEQ ID NO: 1387875 - RNA, 19 nt, Human
cagcagcugagccagccac

SEQ ID NO: 1387876 - RNA, 27 nt, Human
cagcaggcagggccuugaagccuccag

SEQ ID NO: 1387877 - RNA, 20 nt, Human
cagcagggagggaacagagc

SEQ ID NO: 1387878 - RNA, 24 nt, Human
cagcauggaacccucaaugcauag

SEQ ID NO: 1387879 - RNA, 20 nt, Human
cagccuccugaguagcuggg

SEQ ID NO: 1387880 - RNA, 27 nt, Human
cagcugagucugcugauccaacugugc

SEQ ID NO: 1387881 - RNA, 23 nt, Human
caggaauccacagcaagucucuc

SEQ ID NO: 1387882 - RNA, 21 nt, Human
cagggaggccacagaggucag

SEQ ID NO: 1387883 - RNA, 21 nt, Human
cagggccagacucugccccau

SEQ ID NO: 1387884 - RNA, 22 nt, Human
cagggccuggugucgggguccc

SEQ ID NO: 1387885 - RNA, 27 nt, Human
caggucccaaagcagcagugcucaaag

SEQ ID NO: 1387886 - RNA, 19 nt, Human
caggugcccgccaccgugc

SEQ ID NO: 1387887 - RNA, 22 nt, Human
caguggcucuuccagggccaga

SEQ ID NO: 1387888 - RNA, 20 nt, Human
caguggugcgaucuuggcuc

SEQ ID NO: 1387889 - RNA, 22 nt, Human
cauucggggacaggauccgccc

SEQ ID NO: 1387890 - RNA, 20 nt, Human
ccaaggaaaaaacaagagaa

SEQ ID NO: 1387891 - RNA, 21 nt, Human
ccaaggaaaaaacaagagaau

SEQ ID NO: 1387892 - RNA, 24 nt, Human
ccaaggacaaacccccugucaggu

SEQ ID NO: 1387893 - RNA, 22 nt, Human
ccaaggcccagaaccaaggucc

SEQ ID NO: 1387894 - RNA, 21 nt, Human
ccacccccuccaccucaccca

SEQ ID NO: 1387895 - RNA, 24 nt, Human
ccacuugucaguacauuuuauuuc

SEQ ID NO: 1387896 - RNA, 24 nt, Human
ccaggccuccggcagcggcccaug

SEQ ID NO: 1387897 - RNA, 19 nt, Human
ccaguggccagcuggccag

SEQ ID NO: 1387898 - RNA, 22 nt, Human
ccagugggucccacaaugaccc

SEQ ID NO: 1387899 - RNA, 23 nt, Human
ccaucuacaaggucagcacaaaa

SEQ ID NO: 1387900 - RNA, 21 nt, Human
ccauggaugcuggguccuggg

SEQ ID NO: 1387901 - RNA, 22 nt, Human
ccauguuggccaggauggucuc

SEQ ID NO: 1387902 - RNA, 23 nt, Human
ccauguuggccaggauggucucg

SEQ ID NO: 1387903 - RNA, 23 nt, Human
cccaaccgccaugucaccuucuu

SEQ ID NO: 1387904 - RNA, 22 nt, Human
cccaagccccuuugaccaagag

SEQ ID NO: 1387905 - RNA, 22 nt, Human
cccacaaugacccucagugacc

SEQ ID NO: 1387906 - RNA, 18 nt, Human
cccaccccacucccagac

SEQ ID NO: 1387907 - RNA, 18 nt, Human
cccacuaugaauagaggc

SEQ ID NO: 1387908 - RNA, 20 nt, Human
cccagaaccaagguccagca

SEQ ID NO: 1387909 - RNA, 23 nt, Human
cccaggaauccacagcaagucuc

SEQ ID NO: 1387910 - RNA, 21 nt, Human
cccagguccccacuucccagg

SEQ ID NO: 1387911 - RNA, 21 nt, Human
ccccaagccccuuugaccaag

SEQ ID NO: 1387912 - RNA, 25 nt, Human
ccccaccccacucccagacgaagga

SEQ ID NO: 1387913 - RNA, 22 nt, Human
ccccacucccagacaagggacc

SEQ ID NO: 1387914 - RNA, 20 nt, Human
ccccauggaguugcuguggg

SEQ ID NO: 1387915 - RNA, 23 nt, Human
cccccuccaccccaucagggucc

SEQ ID NO: 1387916 - RNA, 20 nt, Human
cccccuccaccucacccaua

SEQ ID NO: 1387917 - RNA, 24 nt, Human
cccccugacccaacccaugaugac

SEQ ID NO: 1387918 - RNA, 22 nt, Human
ccccuaccuaacugcccaaggg

SEQ ID NO: 1387919 - RNA, 22 nt, Human
ccccugacccaacccaugauga

SEQ ID NO: 1387920 - RNA, 22 nt, Human
cccuaugcuuagccuucccucc

SEQ ID NO: 1387921 - RNA, 19 nt, Human
cccuccaccccaucagggu

SEQ ID NO: 1387922 - RNA, 24 nt, Human
cccucuugucgcccaggcuggagu

SEQ ID NO: 1387923 - RNA, 19 nt, Human
cccuguguccagugggucc

SEQ ID NO: 1387924 - RNA, 20 nt, Human
cccuguguccaguggguccc

SEQ ID NO: 1387925 - RNA, 19 nt, Human
ccgaagugcugggguuaca

SEQ ID NO: 1387926 - RNA, 24 nt, Human
ccgaagugcugggguuacaggccu

SEQ ID NO: 1387927 - RNA, 25 nt, Human
ccgcccaccucagccucccgaagug

SEQ ID NO: 1387928 - RNA, 23 nt, Human
ccgucgugugguugcagggcugu

SEQ ID NO: 1387929 - RNA, 22 nt, Human
ccuaugcuuagccuucccucca

SEQ ID NO: 1387930 - RNA, 24 nt, Human
ccuaugcuuagccuucccuccaga

SEQ ID NO: 1387931 - RNA, 24 nt, Human
ccuccaccucacccauaggaucuc

SEQ ID NO: 1387932 - RNA, 24 nt, Human
ccuccaggcagcccucuagagcuc

SEQ ID NO: 1387933 - RNA, 20 nt, Human
ccuccccaccccacucccag

SEQ ID NO: 1387934 - RNA, 22 nt, Human
ccuccccaccccacucccagac

SEQ ID NO: 1387935 - RNA, 23 nt, Human
ccuccccaccccacucccagacg

SEQ ID NO: 1387936 - RNA, 21 nt, Human
ccuccggcagauaaaggagga

SEQ ID NO: 1387937 - RNA, 23 nt, Human
ccucugucauaagccugggcagg

SEQ ID NO: 1387938 - RNA, 18 nt, Human
ccucuguccucguggaga

SEQ ID NO: 1387939 - RNA, 24 nt, Human
ccugaccucaggugauccgcccac

SEQ ID NO: 1387940 - RNA, 22 nt, Human
ccugaguagcugggauuacagg

SEQ ID NO: 1387941 - RNA, 23 nt, Human
ccugaguagcugggauuacaggu

SEQ ID NO: 1387942 - RNA, 24 nt, Human
ccugaguagcugggauuacaggug

SEQ ID NO: 1387943 - RNA, 26 nt, Human
ccugcacugcagugaugaggcuggga

SEQ ID NO: 1387944 - RNA, 20 nt, Human
ccuggguucaagcaauucuc

SEQ ID NO: 1387945 - RNA, 20 nt, Human
ccuggguucaagcaauucuc

SEQ ID NO: 1387946 - RNA, 18 nt, Human
ccuugccccugggugggc

SEQ ID NO: 1387947 - RNA, 19 nt, Human
cgaaggacuccaugugucc

SEQ ID NO: 1387948 - RNA, 19 nt, Human
cgagugcugagggaugcua

SEQ ID NO: 1387949 - RNA, 22 nt, Human
cgccauguuggccaggaugguc

SEQ ID NO: 1387950 - RNA, 24 nt, Human
cgccauguuggccaggauggucuc

SEQ ID NO: 1387951 - RNA, 21 nt, Human
cggcccaggaauccacagcaa

SEQ ID NO: 1387952 - RNA, 22 nt, Human
cggcucaggucccugugguagc

SEQ ID NO: 1387953 - RNA, 24 nt, Human
cgggguuucgccauguuggccagg

SEQ ID NO: 1387954 - RNA, 24 nt, Human
cgugccucagccuccugaguagcu

SEQ ID NO: 1387955 - RNA, 22 nt, Human
cguucuucuacugaggggcauc

SEQ ID NO: 1387956 - RNA, 22 nt, Human
cuaccaggcccaaccgccaugu

SEQ ID NO: 1387957 - RNA, 20 nt, Human
cuacugaggggcaucgcagg

SEQ ID NO: 1387958 - RNA, 20 nt, Human
cuaggaccaugaagaugccc

SEQ ID NO: 1387959 - RNA, 19 nt, Human
cucacacacaacccagaga

SEQ ID NO: 1387960 - RNA, 19 nt, Human
cucacagugcccugguccc

SEQ ID NO: 1387961 - RNA, 19 nt, Human
cucacugcaaccuccacug

SEQ ID NO: 1387962 - RNA, 24 nt, Human
cucagccuccugaguagcugggau

SEQ ID NO: 1387963 - RNA, 19 nt, Human
cuccaaggacaaacccccu

SEQ ID NO: 1387964 - RNA, 23 nt, Human
cuccaaggacaaacccccuguca

SEQ ID NO: 1387965 - RNA, 25 nt, Human
cuccagagaucagacugccugcacu

SEQ ID NO: 1387966 - RNA, 21 nt, Human
cucccagacgaaggacuccau

SEQ ID NO: 1387967 - RNA, 24 nt, Human
cucccucuugucgcccaggcugga

SEQ ID NO: 1387968 - RNA, 25 nt, Human
cucgugccucagccuccugaguagc

SEQ ID NO: 1387969 - RNA, 20 nt, Human
cucucaccggccagcagcug

SEQ ID NO: 1387970 - RNA, 21 nt, Human
cucugcuagccaggcccuacu

SEQ ID NO: 1387971 - RNA, 19 nt, Human
cucugucauaagccugggc

SEQ ID NO: 1387972 - RNA, 19 nt, Human
cucuugucgcccaggcugg

SEQ ID NO: 1387973 - RNA, 21 nt, Human
cugaggaccacccccuccacc

SEQ ID NO: 1387974 - RNA, 21 nt, Human
cugaguagcugggauuacagg

SEQ ID NO: 1387975 - RNA, 19 nt, Human
cugccaggccuccggcagc

SEQ ID NO: 1387976 - RNA, 28 nt, Human
cugccuuguugcuggggugucuccugac

SEQ ID NO: 1387977 - RNA, 20 nt, Human
cugcucauacuuaguaauga

SEQ ID NO: 1387978 - RNA, 18 nt, Human
cugcugccccagcucagc

SEQ ID NO: 1387979 - RNA, 22 nt, Human
cuggaccagucgcugccucucu

SEQ ID NO: 1387980 - RNA, 22 nt, Human
cuggcuggcuggcuggggcugc

SEQ ID NO: 1387981 - RNA, 20 nt, Human
cuuuugggcugggcuccaga

SEQ ID NO: 1387982 - RNA, 18 nt, Human
gaaccaagguccagcagc

SEQ ID NO: 1387983 - RNA, 21 nt, Human
gaacccucaaugcauagcccu

SEQ ID NO: 1387984 - RNA, 20 nt, Human
gaaggcucuucaccccacuc

SEQ ID NO: 1387985 - RNA, 22 nt, Human
gacaccuuugcugucaaaugag

SEQ ID NO: 1387986 - RNA, 20 nt, Human
gaccaggccccccugaccca

SEQ ID NO: 1387987 - RNA, 23 nt, Human
gaccccgcugcccagguccccac

SEQ ID NO: 1387988 - RNA, 24 nt, Human
gaccucaggugauccgcccaccuc

SEQ ID NO: 1387989 - RNA, 18 nt, Human
gacuugguccuggagaac

SEQ ID NO: 1387990 - RNA, 19 nt, Human
gagaaucacccccuccacc

SEQ ID NO: 1387991 - RNA, 21 nt, Human
gagaaucacccccuccacccc

SEQ ID NO: 1387992 - RNA, 24 nt, Human
gagacgggguuucgccauguuggc

SEQ ID NO: 1387993 - RNA, 19 nt, Human
gaggaccacccccuccacc

SEQ ID NO: 1387994 - RNA, 20 nt, Human
gaggagccucgucagcaugg

SEQ ID NO: 1387995 - RNA, 19 nt, Human
gagggaaaacagcagccag

SEQ ID NO: 1387996 - RNA, 21 nt, Human
gaguccagcguagcacagggc

SEQ ID NO: 1387997 - RNA, 19 nt, Human
gaguugcuguggggaugaa

SEQ ID NO: 1387998 - RNA, 20 nt, Human
gaucucugucccaguggcuc

SEQ ID NO: 1387999 - RNA, 19 nt, Human
gauguugccuugccccugg

SEQ ID NO: 1388000 - RNA, 18 nt, Human
gauuacaggugcccgcca

SEQ ID NO: 1388001 - RNA, 24 nt, Human
gauuacaggugcccgccaccgugc

SEQ ID NO: 1388002 - RNA, 22 nt, Human
gcaaccuccacugccuggguuc

SEQ ID NO: 1388003 - RNA, 21 nt, Human
gcacugacacgggcagcucug

SEQ ID NO: 1388004 - RNA, 19 nt, Human
gcacugcacagggcagggc

SEQ ID NO: 1388005 - RNA, 19 nt, Human
gcagcaggcagggccuuga

SEQ ID NO: 1388006 - RNA, 22 nt, Human
gcagcugagccagccacccaga

SEQ ID NO: 1388007 - RNA, 21 nt, Human
gcagggccuggugucgggguc

SEQ ID NO: 1388008 - RNA, 21 nt, Human
gcccaagggcagaaggcucuu

SEQ ID NO: 1388009 - RNA, 20 nt, Human
gcccaggcuggaguucagug

SEQ ID NO: 1388010 - RNA, 26 nt, Human
gcccccuccacagugugggcggccug

SEQ ID NO: 1388011 - RNA, 20 nt, Human
gcccgucgugugguugcagg

SEQ ID NO: 1388012 - RNA, 23 nt, Human
gcccucuagagcuccuucauuuu

SEQ ID NO: 1388013 - RNA, 29 nt, Human
gccuccccaccccacucccagacgaagga

SEQ ID NO: 1388014 - RNA, 18 nt, Human
gccucucaccggccagca

SEQ ID NO: 1388015 - RNA, 19 nt, Human
gccuggguucaagcaauuc

SEQ ID NO: 1388016 - RNA, 19 nt, Human
gcggggucccagcuuaggg

SEQ ID NO: 1388017 - RNA, 26 nt, Human
gcucaaaguccccuaccuaacugccc

SEQ ID NO: 1388018 - RNA, 22 nt, Human
gcucuuccagggccagacucug

SEQ ID NO: 1388019 - RNA, 21 nt, Human
gcugagccagccacccagaaa

SEQ ID NO: 1388020 - RNA, 18 nt, Human
gcugcgacgcagcugggc

SEQ ID NO: 1388021 - RNA, 20 nt, Human
gcuggcuggcuggcuggcug

SEQ ID NO: 1388022 - RNA, 22 nt, Human
gcuuccggagcugggcaguauu

SEQ ID NO: 1388023 - RNA, 18 nt, Human
ggaaaacagcagccaggg

SEQ ID NO: 1388024 - RNA, 19 nt, Human
ggacaggauccgccccaug

SEQ ID NO: 1388025 - RNA, 24 nt, Human
ggauggucucgaacuccugaccuc

SEQ ID NO: 1388026 - RNA, 21 nt, Human
ggcaaagaggcuccaaggaca

SEQ ID NO: 1388027 - RNA, 21 nt, Human
ggcaggagggaaaacagcagc

SEQ ID NO: 1388028 - RNA, 22 nt, Human
ggcagggaggccacagagguca

SEQ ID NO: 1388029 - RNA, 18 nt, Human
ggcagggccuggugucgg

SEQ ID NO: 1388030 - RNA, 24 nt, Human
ggccuccccaccccacucccagac

SEQ ID NO: 1388031 - RNA, 25 nt, Human
ggccuggugucggggucccaguggg

SEQ ID NO: 1388032 - RNA, 23 nt, Human
gggaccaagcuuugggcacagac

SEQ ID NO: 1388033 - RNA, 22 nt, Human
gggaggccacagaggucagggc

SEQ ID NO: 1388034 - RNA, 21 nt, Human
gggcacagacuuggacugagg

SEQ ID NO: 1388035 - RNA, 21 nt, Human
gggcagggccuggugucgggg

SEQ ID NO: 1388036 - RNA, 18 nt, Human
gggcuucguuuuccugga

SEQ ID NO: 1388037 - RNA, 23 nt, Human
gggguuucgccauguuggccagg

SEQ ID NO: 1388038 - RNA, 18 nt, Human
ggucagaggccccagggc

SEQ ID NO: 1388039 - RNA, 18 nt, Human
gguccagaaccccaggga

SEQ ID NO: 1388040 - RNA, 23 nt, Human
guagagacgggguuucgccaugu

SEQ ID NO: 1388041 - RNA, 24 nt, Human
gugauccgcccaccucagccuccc

SEQ ID NO: 1388042 - RNA, 22 nt, Human
gugccucagccuccugaguagc

SEQ ID NO: 1388043 - RNA, 22 nt, Human
guggaggacgguggacuccaca

SEQ ID NO: 1388044 - RNA, 23 nt, Human
uaaaggaggacggcaguguugcg

SEQ ID NO: 1388045 - RNA, 20 nt, Human
uaagaaagccuccucugagc

SEQ ID NO: 1388046 - RNA, 24 nt, Human
uaagaaagccuccucugagcagaa

SEQ ID NO: 1388047 - RNA, 24 nt, Human
uaagccugggcagggccugguguc

SEQ ID NO: 1388048 - RNA, 24 nt, Human
uaauuuuugcauguuuaguagaga

SEQ ID NO: 1388049 - RNA, 24 nt, Human
uacagcaucagggcucacagugcc

SEQ ID NO: 1388050 - RNA, 25 nt, Human
uaccaggcccaaccgccaugucacc

SEQ ID NO: 1388051 - RNA, 18 nt, Human
uaccuaacugcccaaggg

SEQ ID NO: 1388052 - RNA, 18 nt, Human
uagacaucucaccugugg

SEQ ID NO: 1388053 - RNA, 22 nt, Human
uagagacgggguuucgccaugu

SEQ ID NO: 1388054 - RNA, 23 nt, Human
uagaggcaaagaggcuccaagga

SEQ ID NO: 1388055 - RNA, 21 nt, Human
uagcacugcacagggcagggc

SEQ ID NO: 1388056 - RNA, 24 nt, Human
uaguagagacgggguuucgccaug

SEQ ID NO: 1388057 - RNA, 19 nt, Human
ucacugcaaccuccacugc

SEQ ID NO: 1388058 - RNA, 24 nt, Human
ucacugcaaccuccacugccuggg

SEQ ID NO: 1388059 - RNA, 20 nt, Human
ucagccucccgaagugcugg

SEQ ID NO: 1388060 - RNA, 20 nt, Human
ucagccuccugaguagcugg

SEQ ID NO: 1388061 - RNA, 19 nt, Human
ucaguggugcgaucuuggc

SEQ ID NO: 1388062 - RNA, 20 nt, Human
ucaguggugcgaucuuggcu

SEQ ID NO: 1388063 - RNA, 21 nt, Human
uccacaauucccagcugucaa

SEQ ID NO: 1388064 - RNA, 18 nt, Human
uccacagcaagucucuca

SEQ ID NO: 1388065 - RNA, 21 nt, Human
uccaccccaucaggguccaga

SEQ ID NO: 1388066 - RNA, 23 nt, Human
uccagggcagggaggccacagag

SEQ ID NO: 1388067 - RNA, 24 nt, Human
uccagggcagggaggccacagagg

SEQ ID NO: 1388068 - RNA, 20 nt, Human
uccagggccagacucugccc

SEQ ID NO: 1388069 - RNA, 21 nt, Human
uccauguguccaguggguccc

SEQ ID NO: 1388070 - RNA, 18 nt, Human
uccccaagccccuuugac

SEQ ID NO: 1388071 - RNA, 18 nt, Human
uccccaagccccuuugac

SEQ ID NO: 1388072 - RNA, 19 nt, Human
ucccgaagugcugggguua

SEQ ID NO: 1388073 - RNA, 24 nt, Human
ucccgaagugcugggguuacaggc

SEQ ID NO: 1388074 - RNA, 23 nt, Human
ucccucuugucgcccaggcugga

SEQ ID NO: 1388075 - RNA, 21 nt, Human
uccgcccaccucagccucccg

SEQ ID NO: 1388076 - RNA, 18 nt, Human
uccgggugcucauccauc

SEQ ID NO: 1388077 - RNA, 19 nt, Human
uccucggcacccgcccaga

SEQ ID NO: 1388078 - RNA, 24 nt, Human
uccugaguagcugggauuacaggu

SEQ ID NO: 1388079 - RNA, 23 nt, Human
uccuggguucugggacuugacuu

SEQ ID NO: 1388080 - RNA, 24 nt, Human
uccuggguucugggacuugacuuu

SEQ ID NO: 1388081 - RNA, 24 nt, Human
ucgccauguuggccaggauggucu

SEQ ID NO: 1388082 - RNA, 18 nt, Human
ucgcccaggcuggaguuc

SEQ ID NO: 1388083 - RNA, 24 nt, Human
ucucccucuugucgcccaggcugg

SEQ ID NO: 1388084 - RNA, 25 nt, Human
ucucccucuugucgcccaggcugga

SEQ ID NO: 1388085 - RNA, 23 nt, Human
ucucgaacuccugaccucaggug

SEQ ID NO: 1388086 - RNA, 20 nt, Human
ucucuggaccagucgcugcc

SEQ ID NO: 1388087 - RNA, 21 nt, Human
ucugccccaucaggggcugga

SEQ ID NO: 1388088 - RNA, 18 nt, Human
ucuuccagggccagacuc

SEQ ID NO: 1388089 - RNA, 20 nt, Human
ucuuugggaaggacuugugc

SEQ ID NO: 1388090 - RNA, 20 nt, Human
ugacacaagcagucaaagag

SEQ ID NO: 1388091 - RNA, 22 nt, Human
ugacacaagcagucaaagagag

SEQ ID NO: 1388092 - RNA, 18 nt, Human
ugacacgggcagcucugu

SEQ ID NO: 1388093 - RNA, 21 nt, Human
ugacacgggcagcucugucuc

SEQ ID NO: 1388094 - RNA, 21 nt, Human
ugaccaaaucucucacugacc

SEQ ID NO: 1388095 - RNA, 22 nt, Human
ugaccaggccccccugacccaa

SEQ ID NO: 1388096 - RNA, 20 nt, Human
ugacccuagacaucucaccu

SEQ ID NO: 1388097 - RNA, 19 nt, Human
ugacccucagugaccacau

SEQ ID NO: 1388098 - RNA, 21 nt, Human
ugaccgcaccugaagucugag

SEQ ID NO: 1388099 - RNA, 18 nt, Human
ugaccucaggugauccgc

SEQ ID NO: 1388100 - RNA, 21 nt, Human
ugaccucaggugauccgccca

SEQ ID NO: 1388101 - RNA, 24 nt, Human
ugaccucaggugauccgcccaccu

SEQ ID NO: 1388102 - RNA, 20 nt, Human
ugacucuagacaucucaccu

SEQ ID NO: 1388103 - RNA, 19 nt, Human
ugaggcugggaagaggcag

SEQ ID NO: 1388104 - RNA, 21 nt, Human
ugaggcugggaagaggcagca

SEQ ID NO: 1388105 - RNA, 21 nt, Human
ugauccaacugugccucucac

SEQ ID NO: 1388106 - RNA, 23 nt, Human
ugaugagaccuccuccugugggg

SEQ ID NO: 1388107 - RNA, 27 nt, Human
ugauucccugucccuggaccagucucc

SEQ ID NO: 1388108 - RNA, 23 nt, Human
ugcccaagggcagaaggcucuuc

SEQ ID NO: 1388109 - RNA, 18 nt, Human
ugcccugguccccucugu

SEQ ID NO: 1388110 - RNA, 21 nt, Human
ugcccugguccccucuguggu

SEQ ID NO: 1388111 - RNA, 24 nt, Human
ugccucagccuccugaguagcugg

SEQ ID NO: 1388112 - RNA, 24 nt, Human
ugcgacgcagcugggcgugugcca

SEQ ID NO: 1388113 - RNA, 19 nt, Human
ugcugaggguaaagggccc

SEQ ID NO: 1388114 - RNA, 20 nt, Human
ugcuggguccugggcuuugg

SEQ ID NO: 1388115 - RNA, 18 nt, Human
ugcuguggggaugaagga

SEQ ID NO: 1388116 - RNA, 20 nt, Human
ugcuucgagacagcuucuuu

SEQ ID NO: 1388117 - RNA, 24 nt, Human
ugcuucgagacagcuucuuuuccu

SEQ ID NO: 1388118 - RNA, 22 nt, Human
uggaauccagggcagggaggcc

SEQ ID NO: 1388119 - RNA, 23 nt, Human
uggaguugcuguggggaugaagg

SEQ ID NO: 1388120 - RNA, 24 nt, Human
uggccaggauggucucgaacuccu

SEQ ID NO: 1388121 - RNA, 23 nt, Human
uggccaggccucugcuagccagg

SEQ ID NO: 1388122 - RNA, 20 nt, Human
uggcccagggucacaucugg

SEQ ID NO: 1388123 - RNA, 20 nt, Human
uggcgagugcugagggaugc

SEQ ID NO: 1388124 - RNA, 24 nt, Human
uggcucuuccagggccagacucug

SEQ ID NO: 1388125 - RNA, 20 nt, Human
ugggaauacuugggacaaag

SEQ ID NO: 1388126 - RNA, 21 nt, Human
ugggauuacaggugcccgcca

SEQ ID NO: 1388127 - RNA, 22 nt, Human
ugggauuacaggugcccgccac

SEQ ID NO: 1388128 - RNA, 23 nt, Human
ugggauuacaggugcccgccacc

SEQ ID NO: 1388129 - RNA, 23 nt, Human
ugggauuacaggugcccgccacc

SEQ ID NO: 1388130 - RNA, 24 nt, Human
ugggauuacaggugcccgccaccg

SEQ ID NO: 1388131 - RNA, 21 nt, Human
ugggcgugugccaccugggcu

SEQ ID NO: 1388132 - RNA, 24 nt, Human
ugggcuccuuccaugccacguucu

SEQ ID NO: 1388133 - RNA, 21 nt, Human
ugggcuguuccaggcaccugg

SEQ ID NO: 1388134 - RNA, 18 nt, Human
ugggguuacaggccugag

SEQ ID NO: 1388135 - RNA, 19 nt, Human
ugggguuacaggccugagc

SEQ ID NO: 1388136 - RNA, 22 nt, Human
ugggguuacaggccugagcuac

SEQ ID NO: 1388137 - RNA, 21 nt, Human
uggugucggggucccaguggg

SEQ ID NO: 1388138 - RNA, 21 nt, Human
ugucauaagccugggcagggc

SEQ ID NO: 1388139 - RNA, 20 nt, Human
ugucggggucccagugggcu

SEQ ID NO: 1388140 - RNA, 24 nt, Human
uguuuaguagagacgggguuucgc

SEQ ID NO: 1388141 - RNA, 19 nt, Human
uuacaggccugagcuacca

SEQ ID NO: 1388142 - RNA, 18 nt, Human
uuaguagagacgggguuu

SEQ ID NO: 1388143 - RNA, 22 nt, Human
uuaguagagacgggguuucgcc

SEQ ID NO: 1388144 - RNA, 24 nt, Human
uuaguagagacgggguuucgccau

SEQ ID NO: 1388145 - RNA, 25 nt, Human
uucaccccacucccagacaagggac

SEQ ID NO: 1388146 - RNA, 21 nt, Human
uucccaggucccaaagcagca

SEQ ID NO: 1388147 - RNA, 23 nt, Human
uuccuggaucaccaaggaaaaaa

SEQ ID NO: 1388148 - RNA, 18 nt, Human
uugcuguggggaugaagg

SEQ ID NO: 1388149 - RNA, 19 nt, Human
uugggacaaagggaagaca

SEQ ID NO: 1388150 - RNA, 22 nt, Human
uugggacaaagggaagacaaga

SEQ ID NO: 1388151 - RNA, 21 nt, Human
uuuaguagagacgggguuucg

SEQ ID NO: 1388152 - RNA, 19 nt, Human
uuucgccauguuggccagg

SEQ ID NO: 1388153 - RNA, 20 nt, Human
uuuuccuuuugagaugaagu

SEQ ID NO: 1388154 - RNA, 20 nt, Human
uuuuugcauguuuaguagag

SEQ ID NO: 1388155 - RNA, 19 nt, Human
aauuucuuccuuguuucuc

SEQ ID NO: 1388156 - RNA, 21 nt, Human
acccucauacugaacucuggc

SEQ ID NO: 1388157 - RNA, 25 nt, Human
aggauaaugggguaacgggggucaa

SEQ ID NO: 1388158 - RNA, 22 nt, Human
aucauauuccacaucaaacauc

SEQ ID NO: 1388159 - RNA, 23 nt, Human
caucuucauucugaguaucgggg

SEQ ID NO: 1388160 - RNA, 25 nt, Human
cauuucuccuuuaagaucaucaaaa

SEQ ID NO: 1388161 - RNA, 19 nt, Human
cccucauacugaacucugg

SEQ ID NO: 1388162 - RNA, 25 nt, Human
cccucauacugaacucuggcuucau

SEQ ID NO: 1388163 - RNA, 22 nt, Human
ccucauacugaacucuggcuuc

SEQ ID NO: 1388164 - RNA, 18 nt, Human
guauccaacauuucccuc

SEQ ID NO: 1388165 - RNA, 25 nt, Human
uauuccacaucaaacaucuccuuca

SEQ ID NO: 1388166 - RNA, 19 nt, Human
uccaaaugcuuuuucuugg

SEQ ID NO: 1388167 - RNA, 22 nt, Human
uccaaaugcuuuuucuuggcac

SEQ ID NO: 1388168 - RNA, 20 nt, Human
uccaagucuucaaagucacc

SEQ ID NO: 1388169 - RNA, 22 nt, Human
uccaagucuucaaagucaccgu

SEQ ID NO: 1388170 - RNA, 19 nt, Human
ucccaggucgaaaacccuc

SEQ ID NO: 1388171 - RNA, 19 nt, Human
ucccucgcuguugcccaag

SEQ ID NO: 1388172 - RNA, 22 nt, Human
ucugaguaucggggcccgauuu

SEQ ID NO: 1388173 - RNA, 21 nt, Human
uucacagggaacauuuucaau

SEQ ID NO: 1388174 - RNA, 21 nt, Human
uucagcugugcuuguuucugc

SEQ ID NO: 1388175 - RNA, 21 nt, Human
uuccaagucuucaaagucacc

SEQ ID NO: 1388176 - RNA, 23 nt, Human
uuccaagucuucaaagucaccgu

SEQ ID NO: 1388177 - RNA, 24 nt, Human
uuucccucgcuguugcccaagcca

SEQ ID NO: 1388178 - RNA, 22 nt, Human
aagauuauuuguuagcagccuu

SEQ ID NO: 1388179 - RNA, 25 nt, Human
aagcuuucuuuucuggagaacaacu

SEQ ID NO: 1388180 - RNA, 26 nt, Human
acacagacccagggaggggggaacgc

SEQ ID NO: 1388181 - RNA, 26 nt, Human
aguuuuuuuuuucucuaauaucauuu

SEQ ID NO: 1388182 - RNA, 20 nt, Human
aucuuccucaggacccaaua

SEQ ID NO: 1388183 - RNA, 18 nt, Human
auguagccaaaauaguaa

SEQ ID NO: 1388184 - RNA, 19 nt, Human
caaagacugaagcacauca

SEQ ID NO: 1388185 - RNA, 22 nt, Human
cagcacacagacccagggaggg

SEQ ID NO: 1388186 - RNA, 22 nt, Human
caggagcucagaagcggucaug

SEQ ID NO: 1388187 - RNA, 21 nt, Human
ccaguggccucacagcugaca

SEQ ID NO: 1388188 - RNA, 20 nt, Human
ccucacagcugacagggccu

SEQ ID NO: 1388189 - RNA, 18 nt, Human
cggcagcaggagcucaga

SEQ ID NO: 1388190 - RNA, 20 nt, Human
cuuugacucagcaccagugg

SEQ ID NO: 1388191 - RNA, 20 nt, Human
gcaccaguggccucacagcu

SEQ ID NO: 1388192 - RNA, 20 nt, Human
gcucugagcacagggaugag

SEQ ID NO: 1388193 - RNA, 19 nt, Human
gcuugaacugggcaacagc

SEQ ID NO: 1388194 - RNA, 25 nt, Human
uagccaaaauaguaaucuuccucag

SEQ ID NO: 1388195 - RNA, 20 nt, Human
uccaagcuuucuuuucugga

SEQ ID NO: 1388196 - RNA, 18 nt, Human
ucccuuugacucagcacc

SEQ ID NO: 1388197 - RNA, 22 nt, Human
ucuaauaucauuuaaccaaaaa

SEQ ID NO: 1388198 - RNA, 21 nt, Human
ugacagggccuaaaugcggca

SEQ ID NO: 1388199 - RNA, 24 nt, Human
ugacucagcaccaguggccucaca

SEQ ID NO: 1388200 - RNA, 21 nt, Human
ugcauuuauuauacaaagacu

SEQ ID NO: 1388201 - RNA, 20 nt, Human
ugcuuuauucuucgcuguca

SEQ ID NO: 1388202 - RNA, 20 nt, Human
uggaauaacagcacacagac

SEQ ID NO: 1388203 - RNA, 26 nt, Human
ugucuuauucuccagaugcagguuua

SEQ ID NO: 1388204 - RNA, 24 nt, Human
uucccuuugacucagcaccagugg

SEQ ID NO: 1388205 - RNA, 19 nt, Human
uuuuuuuuuuuauaggggc

SEQ ID NO: 1388206 - RNA, 21 nt, Human
aaaagaaaugcagaucugauc

SEQ ID NO: 1388207 - RNA, 23 nt, Human
aaaagaaaugcagaucugaucca

SEQ ID NO: 1388208 - RNA, 21 nt, Human
aaccccauuggcccuguccuc

SEQ ID NO: 1388209 - RNA, 19 nt, Human
aacucauucucugccuccu

SEQ ID NO: 1388210 - RNA, 20 nt, Human
aaggagaggcugcagcagca

SEQ ID NO: 1388211 - RNA, 19 nt, Human
aaucaagggccugguagac

SEQ ID NO: 1388212 - RNA, 21 nt, Human
acauaaaaggguuuuuagggg

SEQ ID NO: 1388213 - RNA, 19 nt, Human
accagcggcccagggaggc

SEQ ID NO: 1388214 - RNA, 21 nt, Human
acucauucucugccuccuggg

SEQ ID NO: 1388215 - RNA, 19 nt, Human
agacacacggcuccucagu

SEQ ID NO: 1388216 - RNA, 23 nt, Human
agagguucaccuugcugaggugc

SEQ ID NO: 1388217 - RNA, 23 nt, Human
agcccaggcacuguccugggccu

SEQ ID NO: 1388218 - RNA, 22 nt, Human
agcuggcaaccccauuggcccu

SEQ ID NO: 1388219 - RNA, 24 nt, Human
agcugugggccagggcgacuucca

SEQ ID NO: 1388220 - RNA, 19 nt, Human
aggaacucauucucugccu

SEQ ID NO: 1388221 - RNA, 21 nt, Human
aggcaaggcaugcacuuggaa

SEQ ID NO: 1388222 - RNA, 24 nt, Human
aggcagcccucuucucugcgcagg

SEQ ID NO: 1388223 - RNA, 24 nt, Human
aggugggcagggccagccccaggg

SEQ ID NO: 1388224 - RNA, 20 nt, Human
aggugggcgaagcgcgccuc

SEQ ID NO: 1388225 - RNA, 18 nt, Human
caagccucggguccuccc

SEQ ID NO: 1388226 - RNA, 19 nt, Human
cacuccauugccaucuacc

SEQ ID NO: 1388227 - RNA, 19 nt, Human
cacuguggaccccgagcgg

SEQ ID NO: 1388228 - RNA, 18 nt, Human
cagcagcaaaagcgaaca

SEQ ID NO: 1388229 - RNA, 19 nt, Human
cagcagcaaaagcgaacag

SEQ ID NO: 1388230 - RNA, 22 nt, Human
cagcagcaaaagcgaacagaag

SEQ ID NO: 1388231 - RNA, 20 nt, Human
cagcccucuucucugcgcag

SEQ ID NO: 1388232 - RNA, 25 nt, Human
caggccccaaggaugaggaccagga

SEQ ID NO: 1388233 - RNA, 19 nt, Human
cagggccagccccagggcc

SEQ ID NO: 1388234 - RNA, 19 nt, Human
cagggcccugcagagacag

SEQ ID NO: 1388235 - RNA, 21 nt, Human
cauggcggcuuuccgcagugu

SEQ ID NO: 1388236 - RNA, 19 nt, Human
ccaaggaugaggaccagga

SEQ ID NO: 1388237 - RNA, 20 nt, Human
ccacuccauugccaucuacc

SEQ ID NO: 1388238 - RNA, 18 nt, Human
ccagagaugaaaucaagg

SEQ ID NO: 1388239 - RNA, 19 nt, Human
ccagccccagggcccuggg

SEQ ID NO: 1388240 - RNA, 22 nt, Human
ccaggacuuccacccaagacug

SEQ ID NO: 1388241 - RNA, 19 nt, Human
ccaggcagcugugggccag

SEQ ID NO: 1388242 - RNA, 22 nt, Human
ccauugccaucuaccugcucaa

SEQ ID NO: 1388243 - RNA, 18 nt, Human
cccagacgagcuggagaa

SEQ ID NO: 1388244 - RNA, 21 nt, Human
cccagggcccugggcuucgaa

SEQ ID NO: 1388245 - RNA, 19 nt, Human
cccagguagaggacaggag

SEQ ID NO: 1388246 - RNA, 21 nt, Human
ccccauuggcccuguccuccu

SEQ ID NO: 1388247 - RNA, 22 nt, Human
cccgccucuuuccagagaugaa

SEQ ID NO: 1388248 - RNA, 19 nt, Human
cccugccucggugcucccc

SEQ ID NO: 1388249 - RNA, 19 nt, Human
ccgaagagagcugcuuggc

SEQ ID NO: 1388250 - RNA, 24 nt, Human
ccgccucuuuccagagaugaaauc

SEQ ID NO: 1388251 - RNA, 18 nt, Human
ccggagcuggcaacccca

SEQ ID NO: 1388252 - RNA, 24 nt, Human
ccucccugggacccugggaggcca

SEQ ID NO: 1388253 - RNA, 22 nt, Human
ccugggacccugggaggccagg

SEQ ID NO: 1388254 - RNA, 20 nt, Human
cgcaggggcagcccaggcac

SEQ ID NO: 1388255 - RNA, 23 nt, Human
cgccugugcuuguuuccaggagc

SEQ ID NO: 1388256 - RNA, 18 nt, Human
cggcagcuggaagcagag

SEQ ID NO: 1388257 - RNA, 21 nt, Human
cggcccagggaggccaggcag

SEQ ID NO: 1388258 - RNA, 23 nt, Human
cggcuccucaguacacauuccuu

SEQ ID NO: 1388259 - RNA, 18 nt, Human
cgggagggaacgggcggc

SEQ ID NO: 1388260 - RNA, 19 nt, Human
cgggagggaacgggcggca

SEQ ID NO: 1388261 - RNA, 27 nt, Human
cguguacuacaaugcaggccccaagga

SEQ ID NO: 1388262 - RNA, 20 nt, Human
cuacggccggagcagaucgg

SEQ ID NO: 1388263 - RNA, 21 nt, Human
cucacugcccugacaucugcc

SEQ ID NO: 1388264 - RNA, 21 nt, Human
cucagcucaagccucgggucc

SEQ ID NO: 1388265 - RNA, 19 nt, Human
cucauucucugccuccugg

SEQ ID NO: 1388266 - RNA, 23 nt, Human
cucccugggacccugggaggcca

SEQ ID NO: 1388267 - RNA, 19 nt, Human
cuccuccagauacucgccc

SEQ ID NO: 1388268 - RNA, 18 nt, Human
cugaccggcuccaccaaa

SEQ ID NO: 1388269 - RNA, 24 nt, Human
cugcagcagcaaaagcgaacagaa

SEQ ID NO: 1388270 - RNA, 24 nt, Human
cuggagaagcuggugcagguggug

SEQ ID NO: 1388271 - RNA, 21 nt, Human
cuggcccugagggcugagaag

SEQ ID NO: 1388272 - RNA, 22 nt, Human
cugggccuucccuucuggcucc

SEQ ID NO: 1388273 - RNA, 18 nt, Human
cugggcgucugaucauuc

SEQ ID NO: 1388274 - RNA, 19 nt, Human
gaaauggguuuauugcaaa

SEQ ID NO: 1388275 - RNA, 19 nt, Human
gaacucauucucugccucc

SEQ ID NO: 1388276 - RNA, 21 nt, Human
gacaggagugacagguguggu

SEQ ID NO: 1388277 - RNA, 20 nt, Human
gacaggcuggugaucccagg

SEQ ID NO: 1388278 - RNA, 19 nt, Human
gacaggugugguugcccag

SEQ ID NO: 1388279 - RNA, 19 nt, Human
gagaaggagaggcugcagg

SEQ ID NO: 1388280 - RNA, 20 nt, Human
gagcagacacacggcuccuc

SEQ ID NO: 1388281 - RNA, 23 nt, Human
gcagcagcaaaagcgaacagaag

SEQ ID NO: 1388282 - RNA, 19 nt, Human
gcagcugugggccagggcg

SEQ ID NO: 1388283 - RNA, 25 nt, Human
gccagccccagggcccugggcuucg

SEQ ID NO: 1388284 - RNA, 20 nt, Human
gccccagggcccugggcuuc

SEQ ID NO: 1388285 - RNA, 22 nt, Human
gcccugacaucugcccagacga

SEQ ID NO: 1388286 - RNA, 21 nt, Human
gcccugggcuucgaacccggc

SEQ ID NO: 1388287 - RNA, 18 nt, Human
gcccuguccuccugcacc

SEQ ID NO: 1388288 - RNA, 18 nt, Human
gcuccugacgccugugcu

SEQ ID NO: 1388289 - RNA, 20 nt, Human
gcuggacucgguggggccug

SEQ ID NO: 1388290 - RNA, 24 nt, Human
gcuggaucacagaggccgggcucg

SEQ ID NO: 1388291 - RNA, 22 nt, Human
gcuggcccugagggcugagaag

SEQ ID NO: 1388292 - RNA, 18 nt, Human
gcuggugaucccagguag

SEQ ID NO: 1388293 - RNA, 22 nt, Human
ggacucgguggggccuggcugg

SEQ ID NO: 1388294 - RNA, 19 nt, Human
ggagcagacacacggcucc

SEQ ID NO: 1388295 - RNA, 19 nt, Human
ggcaggagggggaugauga

SEQ ID NO: 1388296 - RNA, 19 nt, Human
ggcagggccagccccaggg

SEQ ID NO: 1388297 - RNA, 22 nt, Human
ggcccugggcuucgaacccggc

SEQ ID NO: 1388298 - RNA, 19 nt, Human
ggccuucccuucuggcucc

SEQ ID NO: 1388299 - RNA, 19 nt, Human
ggcugagaaggagaggcuc

SEQ ID NO: 1388300 - RNA, 20 nt, Human
gggaacgggcggcaaaggga

SEQ ID NO: 1388301 - RNA, 23 nt, Human
gggaagaugagauggcaacacug

SEQ ID NO: 1388302 - RNA, 26 nt, Human
gggcaggagggggaugaugaggacuc

SEQ ID NO: 1388303 - RNA, 18 nt, Human
gggcuggacucggugggg

SEQ ID NO: 1388304 - RNA, 23 nt, Human
ggggaccccggagcuggcaaccc

SEQ ID NO: 1388305 - RNA, 21 nt, Human
ggggcagcccaggcacugucc

SEQ ID NO: 1388306 - RNA, 21 nt, Human
ggggccagugggugcugaugu

SEQ ID NO: 1388307 - RNA, 23 nt, Human
ggggccuggcuggcccugagggc

SEQ ID NO: 1388308 - RNA, 23 nt, Human
gggggaugaugaggacucacacu

SEQ ID NO: 1388309 - RNA, 27 nt, Human
gguggggccuggcuggcccugagggcu

SEQ ID NO: 1388310 - RNA, 19 nt, Human
guccugggccuucccuucu

SEQ ID NO: 1388311 - RNA, 19 nt, Human
guccuucagauggguggcu

SEQ ID NO: 1388312 - RNA, 19 nt, Human
gucgcaggggcagcccagg

SEQ ID NO: 1388313 - RNA, 22 nt, Human
gucuugagccacugcagucugg

SEQ ID NO: 1388314 - RNA, 18 nt, Human
gugcggcggcacauggcg

SEQ ID NO: 1388315 - RNA, 20 nt, Human
guggauguuugguggaggug

SEQ ID NO: 1388316 - RNA, 21 nt, Human
gugggccagggcgacuuccac

SEQ ID NO: 1388317 - RNA, 19 nt, Human
uaagccugaacgugggcug

SEQ ID NO: 1388318 - RNA, 18 nt, Human
uagagguauuccaccuuc

SEQ ID NO: 1388319 - RNA, 23 nt, Human
ucaaaagaaaugcagaucugauc

SEQ ID NO: 1388320 - RNA, 22 nt, Human
ucaguacacauucccccacccc

SEQ ID NO: 1388321 - RNA, 24 nt, Human
uccaccaaacagguugcccaggcu

SEQ ID NO: 1388322 - RNA, 23 nt, Human
uccaccugcuggaucacagaggc

SEQ ID NO: 1388323 - RNA, 18 nt, Human
uccaugcugcugcugacc

SEQ ID NO: 1388324 - RNA, 22 nt, Human
uccaugcugcugcugacucgga

SEQ ID NO: 1388325 - RNA, 23 nt, Human
uccauugccaucuaccugcucaa

SEQ ID NO: 1388326 - RNA, 23 nt, Human
ucccugggacccugggaggccag

SEQ ID NO: 1388327 - RNA, 23 nt, Human
uccgcaguguccugucuugagcc

SEQ ID NO: 1388328 - RNA, 21 nt, Human
uccuccagauacucgcccagc

SEQ ID NO: 1388329 - RNA, 21 nt, Human
uccuccauguccgggagggaa

SEQ ID NO: 1388330 - RNA, 20 nt, Human
uccuucagauggguggcugg

SEQ ID NO: 1388331 - RNA, 20 nt, Human
ucgcggaugggcugcaagag

SEQ ID NO: 1388332 - RNA, 21 nt, Human
ucgcggaugggcugcaagagg

SEQ ID NO: 1388333 - RNA, 21 nt, Human
ucugaccggcuccaccaaaca

SEQ ID NO: 1388334 - RNA, 18 nt, Human
ucuguaccagcggcccag

SEQ ID NO: 1388335 - RNA, 19 nt, Human
ucuguaccagcggcccagg

SEQ ID NO: 1388336 - RNA, 22 nt, Human
ucugugugugugugugaucugu

SEQ ID NO: 1388337 - RNA, 26 nt, Human
ucuugagccacugcagucugggcccc

SEQ ID NO: 1388338 - RNA, 20 nt, Human
ugaagccauggcccgcuacg

SEQ ID NO: 1388339 - RNA, 24 nt, Human
ugacaggcuggugaucccagguag

SEQ ID NO: 1388340 - RNA, 18 nt, Human
ugacucggagccccacag

SEQ ID NO: 1388341 - RNA, 19 nt, Human
ugcaggugcagggcagggu

SEQ ID NO: 1388342 - RNA, 18 nt, Human
ugcccagacgagcuggag

SEQ ID NO: 1388343 - RNA, 19 nt, Human
ugcccagacgagcuggaga

SEQ ID NO: 1388344 - RNA, 18 nt, Human
ugccuccugggggacccc

SEQ ID NO: 1388345 - RNA, 18 nt, Human
ugcugauguacuuuggcu

SEQ ID NO: 1388346 - RNA, 18 nt, Human
ugcugcugcugacucgga

SEQ ID NO: 1388347 - RNA, 18 nt, Human
ugcuuguuuccaggagca

SEQ ID NO: 1388348 - RNA, 20 nt, Human
ugggccagggcgacuuccac

SEQ ID NO: 1388349 - RNA, 18 nt, Human
ugggccuucccuucuggc

SEQ ID NO: 1388350 - RNA, 20 nt, Human
ugggcuggguccuucagaug

SEQ ID NO: 1388351 - RNA, 19 nt, Human
ugguggagguggaguucug

SEQ ID NO: 1388352 - RNA, 19 nt, Human
ugguuugccuccagugcag

SEQ ID NO: 1388353 - RNA, 24 nt, Human
uguggauguuugguggagguggag

SEQ ID NO: 1388354 - RNA, 22 nt, Human
uguggucuugccuucgucaaaa

SEQ ID NO: 1388355 - RNA, 18 nt, Human
ugugugugugugugaucu

SEQ ID NO: 1388356 - RNA, 21 nt, Human
ugugugugugugugaucugua

SEQ ID NO: 1388357 - RNA, 19 nt, Human
uguuugguggagguggagu

SEQ ID NO: 1388358 - RNA, 18 nt, Human
uuaguccgggagucaggg

SEQ ID NO: 1388359 - RNA, 19 nt, Human
uucacggauuacuacggcc

SEQ ID NO: 1388360 - RNA, 18 nt, Human
uucuuggugaggucgcgg

SEQ ID NO: 1388361 - RNA, 21 nt, Human
uucuuggugaggucgcggaug

SEQ ID NO: 1388362 - RNA, 18 nt, Human
uugaagccauggcccgcu

SEQ ID NO: 1388363 - RNA, 20 nt, Human
uugaagccauggcccgcuac

SEQ ID NO: 1388364 - RNA, 18 nt, Human
uuugucaaggcagggccc

SEQ ID NO: 1388365 - RNA, 23 nt, Human
aaaggagacaagcccucuaagaa

SEQ ID NO: 1388366 - RNA, 23 nt, Human
aaaugaagagauacaaaagccca

SEQ ID NO: 1388367 - RNA, 19 nt, Human
aagaagcugguccagccga

SEQ ID NO: 1388368 - RNA, 21 nt, Human
aaugaagagauacaaaagccc

SEQ ID NO: 1388369 - RNA, 21 nt, Human
acccgagaagaaauggggagu

SEQ ID NO: 1388370 - RNA, 19 nt, Human
acuuuaagacccgagaaga

SEQ ID NO: 1388371 - RNA, 23 nt, Human
agaaacuguccauucagucuguc

SEQ ID NO: 1388372 - RNA, 24 nt, Human
agaaaggagacaagcccucuaaga

SEQ ID NO: 1388373 - RNA, 25 nt, Human
agaaaggagacaagcccucuaagaa

SEQ ID NO: 1388374 - RNA, 18 nt, Human
agaccagcacaaagucag

SEQ ID NO: 1388375 - RNA, 23 nt, Human
agagcaucauggucccugaccaa

SEQ ID NO: 1388376 - RNA, 23 nt, Human
agaggacaaggguagaaaggaga

SEQ ID NO: 1388377 - RNA, 21 nt, Human
agcuacagaaaauauuacauu

SEQ ID NO: 1388378 - RNA, 18 nt, Human
aggacaaggguagaaagg

SEQ ID NO: 1388379 - RNA, 18 nt, Human
cacuagguguaacaaggu

SEQ ID NO: 1388380 - RNA, 21 nt, Human
cagcaaaugucucuauggcuu

SEQ ID NO: 1388381 - RNA, 24 nt, Human
cagcagcagaagacgaagacucaa

SEQ ID NO: 1388382 - RNA, 21 nt, Human
cagccgagcagcagcagaaga

SEQ ID NO: 1388383 - RNA, 20 nt, Human
caguccugggccccaggcuc

SEQ ID NO: 1388384 - RNA, 21 nt, Human
ccagaccagcacaaagucagg

SEQ ID NO: 1388385 - RNA, 19 nt, Human
cccucuaagaaacugucca

SEQ ID NO: 1388386 - RNA, 20 nt, Human
ccucuugcucuccucaccaa

SEQ ID NO: 1388387 - RNA, 20 nt, Human
cucaaauguccauguagagc

SEQ ID NO: 1388388 - RNA, 24 nt, Human
cugucugcagucaauaugaagagg

SEQ ID NO: 1388389 - RNA, 21 nt, Human
cuuccgaagccgcugcagucc

SEQ ID NO: 1388390 - RNA, 23 nt, Human
gguccagccgagcagcagcagaa

SEQ ID NO: 1388391 - RNA, 22 nt, Human
uaaaugaagagauacaaaagcc

SEQ ID NO: 1388392 - RNA, 22 nt, Human
uccacacccaaggaacugaagc

SEQ ID NO: 1388393 - RNA, 20 nt, Human
uccucuugcucuccucacca

SEQ ID NO: 1388394 - RNA, 25 nt, Human
ucuagagcauccacuagguguaaca

SEQ ID NO: 1388395 - RNA, 24 nt, Human
ucucuauggcuucgggaugaaaau

SEQ ID NO: 1388396 - RNA, 21 nt, Human
ucucuccacuaaaauuuaaaa

SEQ ID NO: 1388397 - RNA, 22 nt, Human
ucuuguguuucugucauagagg

SEQ ID NO: 1388398 - RNA, 21 nt, Human
ugaagagauagccuuuggagc

SEQ ID NO: 1388399 - RNA, 19 nt, Human
ugguccagccgagcagcag

SEQ ID NO: 1388400 - RNA, 22 nt, Human
uuaauuauuuuccaucucucca

SEQ ID NO: 1388401 - RNA, 21 nt, Human
uuccgaagccgcugcaguccu

SEQ ID NO: 1388402 - RNA, 21 nt, Human
uuuaauuauuuuccaucucuc

SEQ ID NO: 1388403 - DNA, 704 bp, Human
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaa

SEQ ID NO: 1388404 - DNA, 1262 bp, Human
gcaaaaactggaagcattccctttgaaaactggcacaagacagggatgccctctctcaccgctcctattcaacatagtgttggaagttctggccagggcaattaggcaggagaaggaaataaagggtattcaattaggaaaagagcaagtcaaattgttcctgtttgcagatgacatgattgtatatctagaaaaccccattgtctcagccccaaatctccttaagctgataagcaacttcagcaaagtctcaggatacaaaataaatgtacaaaaatcacaagcattcttacacaccaacaacagaaaaacagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactttactacaaggctacagtaaccaaaacagcatggtactggtaccaaaacagagatatagatcaatggaacagaacagagccctcagaaataacgccgaatacctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaaaaaaaaaaaaaaa

SEQ ID NO: 1388405 - DNA, 1445 bp, Human
actcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggcccgtttcaatttgctgcaaatggctagccagttctcccagcaccatttattaaatagggaatcttttccccattgcttccttttgtcaggtttgtcaaagatcacatggttgtaggtgtgtggtcttatttctgggttctctattctgttccattgggctatgggccggttctgtaccaccactatgctgttttgggtaccatagtcttgtagaatgtttgaagctgggtagcatgatgcctctagctttgctcttcttgctaagaaatgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctagatattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagctcgtgccaa

SEQ ID NO: 1388406 - DNA, 42 bp, Artificial
  PCR primer
taatacgactcactatagggtgaggtagtaagttgtattgtt

SEQ ID NO: 1388407 - DNA, 41 bp, Artificial
  PCR primer
aattaaccctcactaaagggaaagtagtaagttgtatagtt

SEQ ID NO: 1388408 - DNA, 40 bp, artificial
  PCR primer
taatacgactcactataggcccttattagaggattctgct

SEQ ID NO: 1388409 - DNA, 41 bp, Artificial
  PCR primer
aattaaccctcactaaaggtttttttttcctgagacagagt

SEQ ID NO: 1388410 - DNA, 20 bp, Artificial
  PCR primer
gaggcaggagaattgcttga

SEQ ID NO: 1388411 - DNA, 39 bp, Artificial
  PCR primer
aattaaccctcactaaaggcctgagacagagtcttgctc
